United States Patent
Ostertag et al.

(10) Patent No.: US 8,399,643 B2
(45) Date of Patent: Mar. 19, 2013

(54) NUCLEIC ACIDS ENCODING HYPERACTIVE PIGGYBAC TRANSPOSASES

(75) Inventors: Eric Ostertag, Lexington, KY (US); Blair Madison, Philadelphia, PA (US)

(73) Assignee: Transposagen Biopharmaceuticals, Inc., Lexington, KY (US)

(*) Notice: Subject to any disclaimer, the term of this patent is extended or adjusted under 35 U.S.C. 154(b) by 44 days.

(21) Appl. No.: 12/712,504

(22) Filed: Feb. 25, 2010

(65) Prior Publication Data
US 2010/0287633 A1 Nov. 11, 2010

Related U.S. Application Data

(60) Provisional application No. 61/155,804, filed on Feb. 26, 2009.

(51) Int. Cl.
C07H 21/04 (2006.01)
C12N 5/00 (2006.01)

(52) U.S. Cl. .................. 536/23.2; 536/23.7; 435/320.1; 435/325

(58) Field of Classification Search ........................ None
See application file for complete search history.

(56) References Cited

U.S. PATENT DOCUMENTS

| | | | |
|---|---|---|---|
| 4,873,292 A | 10/1989 | Ogata et al. | |
| 2007/0031967 A1 | 2/2007 | Bigot et al. | |
| 2008/0279838 A1 | 11/2008 | Miskey et al. | |
| 2010/0287633 A1 | 11/2010 | Ostertag et al. | |

FOREIGN PATENT DOCUMENTS

| | | |
|---|---|---|
| FR | 2850395 A1 | 7/2004 |
| WO | 2006/122442 A1 | 11/2006 |
| WO | 2010/099301 A2 | 9/2010 |

OTHER PUBLICATIONS

Sarkar, A., et al., Molecular evolutionary analysis of the widespread piggyBac transposon family and related "domesticated" sequences, Mol Genet Genomics, Nov. 2003;270(2):173-80.
UniProtKB entry Q27026, UniProt (online) Jul. 22, 2008, retrieved on Aug. 2, 2010, Retrieved from the internet <URL: http://www.uniprot.org/uniprot/Q27026.html>.
Yant, S. R., et al., Mutational analysis of the N-terminal DNA-binding domain of sleeping beauty transposase: critical residues for DNA binding and hyperactivity in mammalian cells, Mol Cell Biol. Oct. 2004;24(20):9239-47.
Mitra, R., et al, piggyBac can bypass DNA synthesis during cut and paste transposition, EMBO J. Apr. 9, 2008;27 (7):1097-109.
Ding, S., et al., Efficient transposition of the piggyBac (PB) transposon in mammalian cells and mice, Cell. Aug. 12, 2005;122(3):473-83.
Zayed, H., et al., Development of hyperactive sleeping beauty transposon vectors by mutational analysis, Mol Ther. Feb. 2004;9(2):292-304.
Baus, J., et al., Hyperactive transposase mutants of the Sleeping Beauty transposon, Mol Ther. Dec. 2005;12 (6):1148-56.
Ishida, Y., et al., RET: a poly A-trap retrovirus vector for reversible disruption and expression monitoring of genes in living cells, Nucleic Acids Res. Dec. 15, 1999;27(24):e35.
Shigeoka, T., et al., Suppression of nonsense-mediated mRNA decay permits unbiased gene trapping in mouse embryonic stem cells, Nucleic Acids Res. Feb. 1, 2005;33(2):e20.
Chung, J. H., et al., Characterization of the chicken beta-globin insulator, Proc Natl Acad Sci U S A. Jan. 21, 1997;94(2):575-80.
Burgess-Beusse, B., et al., The insulation of genes from external enhancers and silencing chromatin, Proc Natl Acad Sci U S A. Dec. 10, 2002;99 Suppl 4:16433-7.
Gandolfi, F., et al., Stimulation of early embryonic development in the sheep by co-culture with oviduct epithelial cells, J Reprod Fertil. Sep. 1987;81(1):23-8.
Rexroad, C. E., Jr., et al., Co-culture of ovine ova with oviductal cells in medium 199, J Anim Sci. Apr. 1988;66 (4):947-53.
Eyestone, W. H., et al., Co-culture of early cattle embryos to the blastocyst stage with oviducal tissue or in conditioned medium, J Reprod Fertil. Mar. 1989;85(2):715-20.
Camous, S., et al., Cleavage beyond the block stage and survival after transfer of early bovine embryos cultured with trophoblastic vesicles, J Reprod Fertil. Nov. 1984;72(2):479-85.
Ueda, K., et al., Expression of a full-length cDNA for the human "MDR1" gene confers resistance to colchicine, doxorubicin, and vinblastine, Proc Natl Acad Sci U S A. May 1987;84(9):3004-8.
Flynn, J. A., et al., Nonrandom dimerization of murine leukemia virus genomic RNAs, J Virol. Nov. 2004;78 (22):12129-39.
Flynn, J. A., et al., Two distinct Moloney murine leukemia virus RNAs produced from a single locus dimerize at random, Virology. Jan. 20, 2006;344(2):391-400.
Morita, S., et al., Plat-E: an efficient and stable system for transient packaging of retroviruses, Gene Ther. Jun. 2000;7(12):1063-6.
Pastan, I., et al., A retrovirus carrying an MDR1 cDNA confers multidrug resistance and polarized expression of P-glycoprotein in MDCK cells, Proc Natl Acad Sci U S A. Jun. 1988;85(12):4486-90.
Kane, S. E., et al., Use of a cloned multidrug resistance gene for coamplification and overproduction of major excreted protein, a transformation-regulated secreted acid protease, Mol Cell Biol. Aug. 1988;8(8):3316-21.
Cadinanos, J., et al., Generation of an inducible and optimized piggyBac transposon system, Nucleic Acids Res. 2007;35(12):e87.
Maragathavally, K. J., et al., Chimeric Mos1 and piggyBac transposases result in site-directed integration, FASEB J. Sep. 2006;20(11):1880-2.
Wu, S. C.-Y., et al., piggyBac is a flexible and highly active transposon as compared to sleeping beauty, Tol2, and Mos1 in mammalian cells, Proc Natl Acad Sci U S A. Oct. 10, 2006;103(41):15008-13.
Yusa, K., et al., A hyperactive piggyBac transposase for mammalian applications, Proc Natl Acad Sci U S A. Jan. 25, 2011;108(4):1531-6.

*Primary Examiner* — Deborah Crouch
(74) *Attorney, Agent, or Firm* — Pepper Hamilton, LLP

(57) ABSTRACT

The present invention provides PiggyBac transposase proteins, nucleic acids encoding the same, compositions comprising the same, kits comprising the same, non-human transgenic animals comprising the same, and methods of using the same.

13 Claims, 6 Drawing Sheets

NUCLEIC ACIDS ENCODING HYPERACTIVE PIGGYBAC TRANSPOSASES

CROSS-REFERENCE TO RELATED APPLICATIONS

This application claims priority to U.S. provisional application Ser. No. 61/155,804 filed Feb. 26, 2009, which is incorporated herein by reference in its entirety.

FIELD OF THE INVENTION

The present invention is directed, in part, to PiggyBac transposase proteins, nucleic acids encoding the same, compositions comprising the same, kits comprising the same, non-human transgenic animals, and methods of using the same.

BACKGROUND OF THE INVENTION

The PiggyBac (PB) transposase, part of a larger PB family of transposases found in vertebrates and invertebrate PB transposons, is a compact functional transposase protein that catalyzes the excision and re-integration of the PB transposon (Fraser et al., Insect Mol. Biol., 1996, 5, 141-51; Mitra et al., EMBO J., 2008, 27, 1097-1109; and Ding et al., Cell, 2005, 122, 473-83). In many cases, an increase in the movement of the transposon to another part of the genome is desired. For selection of a hyperactive transposase, one would want to select a transposase that can rapidly and efficiently mobilize a transposon from one genomic location to another. Thus, for a particular experimental period, a hyperactive transposase would be desired to yield a greater number of transposon integrations per cell versus a non-hyperactive transposase. Provided herein are hyperactive PiggyBac transposase proteins, nucleic acids encoding the same, compositions comprising the same, kits comprising the same, non-human transgenic animals comprising the same, and methods of using the same.

SUMMARY OF THE INVENTION

The present invention provides proteins comprising at least 80% sequence identity to SEQ ID NO:2, and comprising at least one of the following amino acid substitutions in SEQ ID NO:2: an asparagine for the serine at position 3; a valine for the isoleucine at position 30; a serine for the alanine at position 46; a threonine for the alanine at position 46; a tryptophan for the isoleucine at position 82; a proline for the serine at position 103; a proline for the arginine at position 119; an alanine for the cysteine at position 125; a leucine for the cysteine at position 125; a serine for the glycine at position 165; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a serine for the asparagine at position 258; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; a proline for the glutamine at position 591; or an arginine for the glutamine at position 591.

In some embodiments, the protein comprises at least 80% sequence identity to SEQ ID NO:2, and comprises at least one of the following amino acid substitutions in SEQ ID NO:2: a serine for the glycine at position 165; a leucine for the methionine at position 185; a glycine for the alanine at position 187; a tryptophan for the phenylalanine at position 200; a proline for the valine at position 207; a phenylalanine for the methionine at position 226; a lysine for the valine at position 240; a leucine for the phenylalanine at position 241; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; an isoleucine for the valine at position 436; a tyrosine for the methionine at position 456; a lysine for the serine at position 486; a leucine for the methionine at position 503; or an isoleucine for the methionine at position 503.

In some embodiments, the protein comprises at least 80% sequence identity to SEQ ID NO:2, and comprises at least one of the amino acid substitutions in SEQ ID NO:2. In some embodiments, the protein comprises at least 90% sequence identity to SEQ ID NO:2, and comprises at least one of the amino acid substitutions in SEQ ID NO:2. In some embodiments, the protein comprises at least 95% sequence identity to SEQ ID NO:2, and comprises at least one of the amino acid substitutions in SEQ ID NO:2. In some embodiments, the protein comprises at least 99% sequence identity to SEQ ID NO:2, and comprises at least one of the amino acid substitutions in SEQ ID NO:2.

In some embodiments, the protein comprises at least 80% sequence identity to SEQ ID NO:2, and comprises more than one of the amino acid substitutions in SEQ ID NO:2. In some embodiments, the protein comprises at least 90% sequence identity to SEQ ID NO:2, and comprises more than one of the amino acid substitutions in SEQ ID NO:2. In some embodiments, the protein comprises at least 95% sequence identity to SEQ ID NO:2, and comprises more than one of the amino acid substitutions in SEQ ID NO:2. In some embodiments, the protein comprises at least 99% sequence identity to SEQ ID NO:2, and comprises more than one of the amino acid substitutions in SEQ ID NO:2.

In some embodiments, the protein comprises SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:94, SEQ ID NO:96, SEQ ID NO:98, SEQ ID NO:100, SEQ ID NO:102, SEQ ID NO:104, SEQ ID NO:106, or SEQ ID NO:108.

In some embodiments, the protein comprises SEQ ID NO:24, SEQ ID NO:26, SEQ ID NO:28, SEQ ID NO:30, SEQ ID NO:34, SEQ ID NO:38, SEQ ID NO:40, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:62, SEQ ID NO:76, SEQ ID NO:78, SEQ ID NO:82, SEQ ID NO:84, SEQ ID NO:86, or SEQ ID NO:102.

The present invention also provides nucleic acids encoding any of the proteins described above. In some embodiments, the nucleic acid comprises SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:93, SEQ ID NO:95, SEQ ID NO:97, SEQ ID NO:99, SEQ ID NO:101, SEQ ID NO:103, SEQ ID NO:105, or SEQ ID NO:107. In some embodiments, the nucleic acid comprises SEQ ID NO:23, SEQ ID NO:25, SEQ ID NO:27, SEQ ID NO:29, SEQ ID NO:33, SEQ ID NO:37, SEQ ID NO:39, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:61, SEQ ID NO:75, SEQ ID NO:77, SEQ ID NO:81, SEQ ID NO:83, SEQ ID NO:85, or SEQ ID NO:101.

The present invention also provides vectors comprising any of the nucleic acids described above encoding any of the proteins described above. In some embodiments, the vector is a plasmid. In some embodiments, the vector is a retrovirus. In some embodiments, the retrovirus comprises long terminal repeats, a psi packaging signal, a cloning site, and a sequence encoding a selectable marker.

The present invention also provides cells comprising any of the nucleic acids or vectors described herein. In some embodiments, the cell is a sperm or an egg.

The present invention also provides kits comprising: a vector comprising a nucleic acid encoding any of the proteins described herein; and a transposon comprising an insertion site for an exogenous nucleic acid, wherein the insertion site is flanked by a first inverted repeat sequence comprising a sequence at least about 90% sequence identity to SEQ ID NO:91 and/or a second inverted repeat sequence comprising a sequence at least about 90% sequence identity to SEQ ID NO:92.

The present invention also provides non-human, transgenic animals comprising a nucleic acid molecule encoding any of the proteins described herein. In some embodiments, the non-human, transgenic animal further comprises a transposon comprising an insertion site for an exogenous nucleic acid, wherein the insertion site is flanked by a first inverted repeat sequence comprising a sequence at least about 90% sequence identity to SEQ ID NO:91 and/or a second inverted repeat sequence comprising a sequence at least about 90% sequence identity to SEQ ID NO:92.

The present invention also provides methods of integrating an exogenous nucleic acid into the genome of at least one cell of a multicellular or unicellular organism comprising administering directly to the multicellular or unicellular organism: a transposon comprising the exogenous nucleic acid, wherein the exogenous nucleic acid is flanked by a first inverted repeat sequence comprising a sequence at least about 90% sequence identity to SEQ ID NO:91 and/or a second inverted repeat sequence comprising a sequence at least about 90% sequence identity to SEQ ID NO:92; and a protein described herein to excise the exogenous nucleic acid from a plasmid, episome, or transgene and integrate the exogenous nucleic acid into the genome. In some embodiments, the protein is administered as a nucleic acid encoding the protein. In some embodiments, the transposon and nucleic acid encoding the protein are present on separate vectors. In some embodiments, the transposon and nucleic acid encoding the protein are present on the same vector. In some embodiments, the multicellular or unicellular organism is a vertebrate. In some embodiments, the vertebrate animal is a mammal. In some embodiments, the administering is administering systemically. In some embodiments, the exogenous nucleic acid comprises a gene.

The present invention also provides methods of generating a non-human, transgenic animal comprising a germline mutation comprising: breeding a first non-human, transgenic animal comprising a transposon with a second non-human, transgenic animal comprising a vector comprising a nucleotide sequence encoding any of the proteins described herein.

The present invention also provides methods of generating a non-human, transgenic animal comprising: introducing a nucleic acid molecule encoding any of the proteins described herein into a cell under conditions sufficient to generate a transgenic animal.

DESCRIPTION OF EMBODIMENTS

Figure 1:
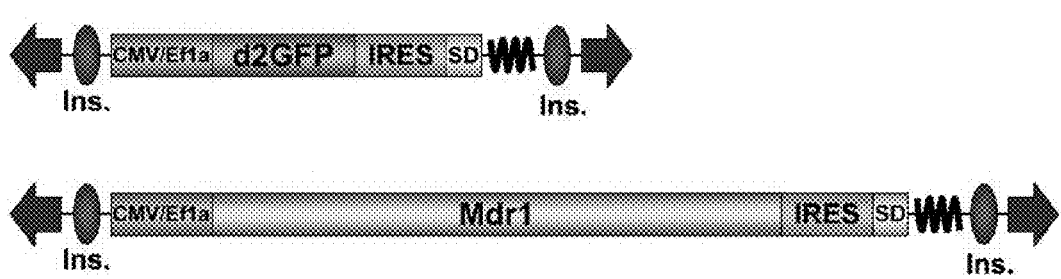
FIG. 1 shows representative BII-sd2GFP and BII-sMdr1 PolyA trap transposons.

The present invention provides hyperactive PiggyBac transposase proteins. In some embodiments, the protein comprises at least 75% sequence identity to SEQ ID NO:2, and comprises a substitution in at least one of the following amino acid positions in SEQ ID NO:2: position 3, position 30, position 46, position 82, position 103, position 119, position 125, position 165, position 177, position 180, position 185, position 187, position 200, position 207, position 209, position 226, position 235, position 240, position 241, position 243, position 258, position 282, position 296, position 298, position 311, position 315, position 319, position 327, position 328, position 340, position 421, position 436, position 456, position 470, position 486, position 503, position 552; position 570, or position 591.

In some embodiments, the protein comprises at least 75% sequence identity to SEQ ID NO:2, and comprises a conservative amino acid substitution in at least one of the following amino acid positions in SEQ ID NO:2: position 3, position 30, position 46, position 82, position 103, position 119, position 125, position 165, position 177, position 180, position 185, position 187, position 200, position 207, position 209, position 226, position 235, position 240, position 241, position 243, position 258, position 282, position 296, position 298, position 311, position 315, position 319, position 327, position 328, position 340, position 421, position 436, position 456, position 470, position 486, position 503, position 552; position 570, or position 591.

In some embodiments, the protein comprises at least 75% sequence identity to SEQ ID NO:2, and comprises at least one of the following amino acid substitutions in SEQ ID NO:2: an asparagine for the serine at position 3; a valine for the isoleucine at position 30; a serine for the alanine at position 46; a threonine for the alanine at position 46; a tryptophan for the isoleucine at position 82; a proline for the serine at position 103; a proline for the arginine at position 119; an alanine for the cysteine at position 125; a leucine for the cysteine at position 125; a serine for the glycine at position 165; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a serine for the asparagine at position 258; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; a proline for the glutamine at position 591; or an arginine for the glutamine at position 591.

In some embodiments, the protein comprises at least 75% sequence identity to SEQ ID NO:2, and comprises a substitution in at least one of the following amino acid positions in SEQ ID NO:2: position 165, position 185, position 187, position 200, position 207, position 226, position 240, position 241, position 282, position 296, position 298, position 311, position 315, position 436, position 456, position 486, or position 503.

In some embodiments, the protein comprises at least 75% sequence identity to SEQ ID NO:2, and comprises a conservative amino acid substitution in at least one of the following amino acid positions in SEQ ID NO:2: position 165, position 185, position 187, position 200, position 207, position 226, position 240, position 241, position 282, position 296, position 298, position 311, position 315, position 436, position 456, position 486, or position 503.

In some embodiments, the protein comprises at least 75% sequence identity to SEQ ID NO:2, and comprises at least one of the following amino acid substitutions in SEQ ID NO:2: a serine for the glycine at position 165; a leucine for the methionine at position 185; a glycine for the alanine at position 187; a tryptophan for the phenylalanine at position 200; a proline for the valine at position 207; a phenylalanine for the methionine at position 226; a lysine for the valine at position 240; a leucine for the phenylalanine at position 241; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; an isoleucine for the valine at position 436; a tyrosine for the methionine at position 456; a lysine for the serine at position 486; a leucine for the methionine at position 503; or an isoleucine for the methionine at position 503.

In some embodiments, the protein (as nucleic acid, as nucleic acid in a vector, or as purified recombinant protein) comprises at least 80% sequence identity to SEQ ID NO:2, and comprises at least one of the aforementioned amino acid substitutions in SEQ ID NO:2. In some embodiments, the protein (as nucleic acid, as nucleic acid in a vector, or as purified recombinant protein) comprises at least 85% sequence identity to SEQ ID NO:2, and comprises at least one of the aforementioned amino acid substitutions in SEQ ID NO:2. In some embodiments, the protein (as nucleic acid, as nucleic acid in a vector, or as purified recombinant protein) comprises at least 90% sequence identity to SEQ ID NO:2, and comprises at least one of the aforementioned amino acid substitutions in SEQ ID NO:2. In some embodiments, the protein (as nucleic acid, as nucleic acid in a vector, or as purified recombinant protein) comprises at least 95% sequence identity to SEQ ID NO:2, and comprises at least one of the aforementioned amino acid substitutions in SEQ ID NO:2. In some embodiments, the protein (as nucleic acid, as nucleic acid in a vector, or as purified recombinant protein) comprises at least 99% sequence identity to SEQ ID NO:2, and comprises at least one of the aforementioned amino acid substitutions in SEQ ID NO:2.

In some embodiments, the protein (as nucleic acid, as nucleic acid in a vector, or as purified recombinant protein) comprises at least 75% sequence identity to SEQ ID NO:2, and comprises more than one of the aforementioned amino acid substitutions in SEQ ID NO:2. In some embodiments, the protein (as nucleic acid, as nucleic acid in a vector, or as purified recombinant protein) comprises at least 80% sequence identity to SEQ ID NO:2, and comprises more than one of the aforementioned amino acid substitutions in SEQ ID NO:2. In some embodiments, the protein (as nucleic acid, as nucleic acid in a vector, or as purified recombinant protein) comprises at least 85% sequence identity to SEQ ID NO:2, and comprises more than one of the aforementioned amino acid substitutions in SEQ ID NO:2. In some embodiments, the protein (as nucleic acid, as nucleic acid in a vector, or as purified recombinant protein) comprises at least 90% sequence identity to SEQ ID NO:2, and comprises more than one of the aforementioned amino acid substitutions in SEQ ID NO:2. In some embodiments, the protein (as nucleic acid, as nucleic acid in a vector, or as purified recombinant protein) comprises at least 95% sequence identity to SEQ ID NO:2, and comprises more than one of the aforementioned amino acid substitutions in SEQ ID NO:2. In some embodiments, the protein (as nucleic acid, as nucleic acid in a vector, or as purified recombinant protein) comprises at least 99% sequence identity to SEQ ID NO:2, and comprises more than one of the aforementioned amino acid substitutions in SEQ ID NO:2.

As used herein, "sequence identity" is determined by using the stand-alone executable BLAST engine program for blasting two sequences (bl2seq), which can be retrieved from the National Center for Biotechnology Information (NCBI) ftp site, using the default parameters (Tatusova and Madden, FEMS Microbiol Lett., 1999, 174, 247-250; which is incorporated herein by reference in its entirety).

As used herein, "conservative" amino acid substitutions may be defined as set out in Tables A, B, or C below. Hyperactive transposases include those wherein conservative substitutions have been introduced by modification of polynucleotides encoding polypeptides of the invention. Amino acids can be classified according to physical properties and contribution to secondary and tertiary protein structure. A conservative substitution is recognized in the art as a substitution of one amino acid for another amino acid that has similar properties. Exemplary conservative substitutions are set out in Table A.

TABLE A

Conservative Substitutions I

| Side Chain Characteristics | Amino Acid |
|---|---|
| Aliphatic | |
| Non-polar | G A P I L V F |
| Polar - uncharged | C S T M N Q |
| Polar - charged | D E K R |
| Aromatic | H F W Y |
| Other | N Q D E |

Alternately, conservative amino acids can be grouped as described in Lehninger, (Biochemistry, Second Edition; Worth Publishers, Inc. NY, N.Y. (1975), pp. 71-77) as set forth in Table B.

TABLE B

Conservative Substitutions II

| Side Chain Characteristic | Amino Acid |
|---|---|
| Non-polar (hydrophobic) | |
| Aliphatic: | A L I V P |
| Aromatic: | F W Y |
| Sulfur-containing: | M |
| Borderline: | G Y |
| Uncharged-polar | |
| Hydroxyl: | S T Y |
| Amides: | N Q |
| Sulfhydryl: | C |
| Borderline: | G Y |
| Positively Charged (Basic): | K R H |
| Negatively Charged (Acidic): | D E |

Alternately, exemplary conservative substitutions are set out in Table C.

TABLE C

Conservative Substitutions III

| Original Residue | Exemplary Substitution |
|---|---|
| Ala (A) | Val Leu Ile Met |
| Arg (R) | Lys His |
| Asn (N) | Gln |
| Asp (D) | Glu |
| Cys (C) | Ser Thr |
| Gln (Q) | Asn |
| Glu (E) | Asp |
| Gly (G) | Ala Val Leu Pro |
| His (H) | Lys Arg |
| Ile (I) | Leu Val Met Ala Phe |
| Leu (L) | Ile Val Met Ala Phe |
| Lys (K) | Arg His |
| Met (M) | Leu Ile Val Ala |
| Phe (F) | Trp Tyr Ile |
| Pro (P) | Gly Ala Val Leu Ile |
| Ser (S) | Thr |
| Thr (T) | Ser |
| Trp (W) | Tyr Phe Ile |
| Tyr (Y) | Trp Phe Thr Ser |
| Val (V) | Ile Leu Met Ala |

It should be understood that the hyperactive PiggyBac transposases described herein are intended to include polypeptides bearing one or more insertions, deletions, or substitutions, or any combination thereof, of amino acid residues as well as modifications other than insertions, deletions, or substitutions of amino acid residues.

As used herein, "more than one" of the aforementioned amino acid substitutions means 2, 3, 4, 5, 6, 7, 8, 9, or 10 of the recited amino acid substitutions. In some embodiments, "more than one" means 2, 3, 4, or 5 of the recited amino acid substitutions. In some embodiments, "more than one" means 2, 3, or 4 of the recited amino acid substitutions. In some embodiments, "more than one" means 2 or 3 of the recited amino acid substitutions. In some embodiments, "more than one" means 2 of the recited amino acid substitutions.

In some embodiments, the protein comprises SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:94, SEQ ID NO:96, SEQ ID NO:98, SEQ ID NO:100, SEQ ID NO:102, SEQ ID NO:104, SEQ ID NO:106, or SEQ ID NO:108.

In some embodiments, the protein comprises SEQ ID NO:24, SEQ ID NO:26, SEQ ID NO:28, SEQ ID NO:30, SEQ ID NO:34, SEQ ID NO:38, SEQ ID NO:40, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:62, SEQ ID NO:76, SEQ ID NO:78, SEQ ID NO:82, SEQ ID NO:84, SEQ ID NO:86, or SEQ ID NO:102.

The present invention also provides nucleic acids encoding any one of the hyperactive PiggyBac transposase proteins described herein. Thus, the present invention provides nucleic acids encoding a protein that comprises at least 75% (or 80%, 85%, 90%, 95%, or 99%) sequence identity to SEQ ID NO:2, and comprises at least one of the following amino acid substitutions in SEQ ID NO:2: an asparagine for the serine at position 3; a valine for the isoleucine at position 30; a serine for the alanine at position 46; a threonine for the alanine at position 46; a tryptophan for the isoleucine at position 82; a proline for the serine at position 103; a proline for the arginine at position 119; an alanine for the cysteine at position 125; a leucine for the cysteine at position 125; a serine for the glycine at position 165; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a serine for the asparagine at position 258; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; a proline for the glutamine at position 591; or an arginine for the glutamine at position 591.

In some embodiments, the nucleic acid encodes a protein that comprises at least 75% (or 80%, 85%, 90%, 95%, or 99%) sequence identity to SEQ ID NO:2, and comprises at least one of the following amino acid substitutions in SEQ ID NO:2: a serine for the glycine at position 165; a leucine for the methionine at position 185; a glycine for the alanine at position 187; a tryptophan for the phenylalanine at position 200; a proline for the valine at position 207; a phenylalanine for the methionine at position 226; a lysine for the valine at position 240; a leucine for the phenylalanine at position 241; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; an isoleucine for the valine at position 436; a tyrosine for the methionine at position 456; a lysine for the serine at position 486; a leucine for the methionine at position 503; or an isoleucine for the methionine at position 503.

Given the redundancy in the genetic code, one skilled in the art could generate numerous nucleotide sequences that encode any particular protein. All such nucleotides sequences are contemplated herein. In some embodiments, the nucleic acid comprises SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:93, SEQ ID NO:95, SEQ ID NO:97, SEQ ID NO:99, SEQ ID NO:101, SEQ ID NO:103, SEQ ID NO:105, or SEQ ID NO:107. In some embodiments, the nucleic acid comprises SEQ ID NO:23, SEQ ID NO:25, SEQ ID NO:27, SEQ ID NO:29, SEQ ID NO:33, SEQ ID NO:37, SEQ ID NO:39, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:61, SEQ ID NO:75, SEQ ID NO:77, SEQ ID NO:81, SEQ ID NO:83, SEQ ID NO:85, or SEQ ID NO:101.

The present invention also provides vectors comprising any of the aforementioned nucleic acids. Thus, the present invention provides vectors comprising a nucleic acid that encodes a protein that comprises at least 75% (or 80%, 85%, 90%, 95%, or 99%) sequence identity to SEQ ID NO:2, and comprises at least one of the following amino acid substitutions in SEQ ID NO:2: an asparagine for the serine at position 3; a valine for the isoleucine at position 30; a serine for the alanine at position 46; a threonine for the alanine at position 46; a tryptophan for the isoleucine at position 82; a proline for the serine at position 103; a proline for the arginine at position 119; an alanine for the cysteine at position 125; a leucine for the cysteine at position 125; a serine for the glycine at position 165; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a serine for the asparagine at position 258; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; a proline for the glutamine at position 591; or an arginine for the glutamine at position 591.

In some embodiments, the vector comprises a nucleic acid that encodes a protein that comprises at least 75% (or 80%, 85%, 90%, 95%, or 99%) sequence identity to SEQ ID NO:2, and comprises at least one of the following amino acid substitutions in SEQ ID NO:2: a serine for the glycine at position 165; a leucine for the methionine at position 185; a glycine for the alanine at position 187; a tryptophan for the phenylalanine at position 200; a proline for the valine at position 207; a phenylalanine for the methionine at position 226; a lysine for the valine at position 240; a leucine for the phenylalanine at position 241; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; an isoleucine for the valine at position 436; a tyrosine for the methionine at position 456; a lysine for the serine at position 486; a leucine for the methionine at position 503; or an isoleucine for the methionine at position 503.

In some embodiments, the vector comprises a nucleic acid that comprises SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:93, SEQ ID NO:95, SEQ ID NO:97, SEQ ID NO:99, SEQ ID NO:101, SEQ ID NO:103, SEQ ID NO:105, or SEQ ID NO:107. In some embodiments, the vector comprises a nucleic acid that comprises SEQ ID NO:23, SEQ ID NO:25, SEQ ID NO:27, SEQ ID NO:29, SEQ ID NO:33, SEQ ID NO:37, SEQ ID NO:39, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:61, SEQ ID NO:75, SEQ ID NO:77, SEQ ID NO:81, SEQ ID NO:83, SEQ ID NO:85, or SEQ ID NO:101.

In some embodiments, the vector is a plasmid. In other embodiments, the vector is a retrovirus. In some embodiments, the vector is a linear DNA molecule. In some embodiments, the retrovirus comprises long terminal repeats, a psi packaging signal, a cloning site, and a sequence encoding a selectable marker. In some embodiments, the vector is a viral vector, such as pLXIN (Clontech).

The present invention also provides cells or organisms comprising any of the aforementioned nucleic acids. Thus, the present invention provides cells or organisms comprising a nucleic acid that encodes a protein that comprises at least 75% (or 80%, 85%, 90%, 95%, or 99%) sequence identity to SEQ ID NO:2, and comprises at least one of the following amino acid substitutions in SEQ ID NO:2: an asparagine for the serine at position 3; a valine for the isoleucine at position 30; a serine for the alanine at position 46; a threonine for the alanine at position 46; a tryptophan for the isoleucine at position 82; a proline for the serine at position 103; a proline for the arginine at position 119; an alanine for the cysteine at position 125; a leucine for the cysteine at position 125; a serine for the glycine at position 165; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a serine for the asparagine at position 258; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; a proline for the glutamine at position 591; or an arginine for the glutamine at position 591.

In some embodiments, the cells or organisms comprise a nucleic acid that encodes a protein that comprises at least 75% (or 80%, 85%, 90%, 95%, or 99%) sequence identity to SEQ ID NO:2, and comprises at least one of the following amino acid substitutions in SEQ ID NO:2: a serine for the glycine at position 165; a leucine for the methionine at position 185; a glycine for the alanine at position 187; a tryptophan for the phenylalanine at position 200; a proline for the valine at position 207; a phenylalanine for the methionine at position 226; a lysine for the valine at position 240; a leucine for the phenylalanine at position 241; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; an isoleucine for the valine at position 436; a tyrosine for the methionine at position 456; a lysine for the serine at position 486; a leucine for the methionine at position 503; or an isoleucine for the methionine at position 503.

In some embodiments, the cells or organisms comprise a nucleic acid that comprises SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:93, SEQ ID NO:95, SEQ ID NO:97, SEQ ID NO:99, SEQ ID NO:101, SEQ ID NO:103, SEQ ID NO:105, or SEQ ID NO:107. In some embodiments, the cells or organisms comprise a nucleic acid that comprises SEQ ID NO:23, SEQ ID NO:25, SEQ ID NO:27, SEQ ID NO:29, SEQ ID NO:33, SEQ ID NO:37, SEQ ID NO:39, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:61, SEQ ID NO:75, SEQ ID NO:77, SEQ ID NO:81, SEQ ID NO:83, SEQ ID NO:85, or SEQ ID NO:101.

In some embodiments, the cell comprises any of the aforementioned vectors.

The present invention also provides kits comprising: 1) any of the aforementioned vectors; and 2) any of the hyperactive PiggyBac transposons described herein comprising an insertion site for an exogenous nucleic acid, wherein the insertion site is flanked by either one or more of the inverted repeat sequences that are specifically recognized by any of the aforementioned proteins. In some embodiments, the inverted repeats comprises a first inverted repeat and/or a second inverted repeat, wherein the first inverted repeat comprises a sequence of at least about 80% sequence identity to SEQ ID NO:91 and the second inverted repeat sequence comprises a sequence at least about 80% sequence identity to SEQ ID NO:92. In some embodiments, the first inverted repeat comprises a sequence at least about 85% sequence identity to SEQ ID NO:91 and the second inverted repeat sequence comprises a sequence at least about 85% sequence identity to SEQ ID NO:92. In some embodiments, the first inverted repeat comprises a sequence at least about 90% sequence identity to SEQ ID NO:91 and the second inverted repeat sequence comprises a sequence at least about 90% sequence identity to SEQ ID NO:92. In some embodiments, the first inverted repeat comprises a sequence at least about 95% sequence identity to SEQ ID NO:91 and the second inverted repeat sequence comprises a sequence at least about 95% sequence identity to SEQ ID NO:92. In some embodiments, the first inverted repeat comprises a sequence at least about 99% sequence identity to SEQ ID NO:91 and the second inverted repeat sequence comprises a sequence at least about 99% sequence identity to SEQ ID NO:92. In some embodiments, the first inverted repeat comprises a sequence identical to SEQ ID NO:91 and the second inverted repeat sequence comprises a sequence identical to SEQ ID NO:92.

As stated above, the aforementioned transposon is a nucleic acid that is flanked at either end by inverted repeats which are recognized by an enzyme having PiggyBac transposase activity. By "recognized" is meant that a PiggyBac transposase, such as any of the aforementioned proteins, is capable of binding to the inverted repeat, excising the segment of nucleic acid flanked by the inverted repeats, and integrating the segment of nucleic acid flanked by the inverted repeats into the genome of the target cell.

In some embodiments, the left (5') inverted repeat sequence is: 5'-CCCTAGAAAG ATAGTCTGCGTAAAAT-TGACGCATG-3' (SEQ ID NO:91) and the right (3') inverted repeat is: 5'-CCCTAGAAAGATAATCATATTGTGACG-TACGTTAAAGATAATCATGC GTAAAATTGACG-CATG-3' (SEQ ID NO:92).

The various elements of the transposon systems described herein can be produced by standard methods of restriction enzyme cleavage, ligation, and molecular cloning. One protocol for constructing the vectors described herein includes the following steps. Purified nucleic acid fragments containing the desired component nucleotide sequences as well as extraneous sequences are cleaved with restriction endonucleases from initial sources, such as a vector comprising the PiggyBac transposase gene. Fragments containing the desired nucleotide sequences are separated from unwanted fragments of different size using conventional separation methods, such as for example, agarose gel electrophoresis. The desired fragments are excised from the gel and ligated together in the appropriate configuration so that a circular nucleic acid or plasmid containing the desired sequences, such as for example, sequences corresponding to the various elements of the subject vectors, as described above is produced. Where desired, the circular molecules so constructed are then amplified in a prokaryotic host, such as for example, E. coli. Alternately, an RNA comprising the PiggyBac transposase can be produced with an RNA polymerase, using a DNA plasmid as a substrate. Recombinant protein comprising the PiggyBac transposase can be produced by methods including, but not limited to, in vitro transcription and translation, or expression in E. coli followed by purification by affinity or fractionation. The procedures of cleavage, plasmid construction, cell transformation, plasmid production, RNA transcription/purification, and recombinant protein purification involved in these steps are well known to one skilled in the art and the enzymes required for restriction and ligation are available commercially. Preparation of a PiggyBac transposon system is disclosed in, for example, WO 2006/122442. Synthesis of at least one of the sequences described herein was generated by GeneArt AG (Regensberg, Germany).

The PiggyBac transposons described herein can include a wide variety of inserted nucleic acids, where the nucleic acids can include a sequence of bases that is endogenous and/or exogenous to a multicellular or unicellular organism. The nature of the nucleic acid can vary depending upon the particular protocol being carried out. In some embodiments, the exogenous nucleic acid can be a gene. The inserted nucleic acid that is positioned between the flanking inverted repeats can vary greatly in size. The only limitation on the size of the inserted nucleic acid is that the size should not be so great as to inactivate the ability of the transposon system to integrate the transposon into the target genome. The upper and lower limits of the size of inserted nucleic acid can be determined empirically by those of skill in the art.

In some embodiments, the inserted nucleic acid comprises at least one transcriptionally active gene, which is a coding sequence that is capable of being expressed under intracellular conditions, e.g. a coding sequence in combination with any requisite expression regulatory elements that are required for expression in the intracellular environment of the target cell whose genome is modified by integration of the transposon. The transcriptionally active genes of the transposon can comprise a domain of nucleotides, i.e., an expression module that includes a coding sequence of nucleotides operably linked with requisite transcriptional mediation or regulatory element(s). Requisite transcriptional mediation elements that may be present in the expression module include, but are not limited to, promoters, enhancers, termination and polyadenylation signal elements, splicing signal elements, and the like.

In some embodiments, the expression module includes transcription regulatory elements that provide for expression of the gene in a broad host range. A variety of such combinations are known, where specific transcription regulatory elements include, but are not limited to: SV40 elements, transcription regulatory elements derived from the LTR of the Rous sarcoma virus, transcription regulatory elements derived from the LTR of human cytomegalovirus (CMV), hsp70 promoters, and the like.

In some embodiments, at least one transcriptionally active gene or expression module present in the inserted nucleic acid acts as a selectable marker. A variety of different genes have been employed as selectable markers, and the particular gene employed in the vectors described herein as a selectable marker is chosen primarily as a matter of convenience. Known selectable marker genes include, but are not limited to: thymidine kinase gene, dihydrofolate reductase gene, xanthine-guanine phosporibosyl transferase gene, CAD, adenosine deaminase gene, asparagine synthetase gene, numerous antibiotic resistance genes (tetracycline, ampicillin, kanamycin, neomycin, and the like), aminoglycoside phosphotransferase genes, hygromycin B phosphotransferase gene, and genes whose expression provides for the presence of a detectable product, either directly or indirectly, such as, for example, beta-galactosidase, GFP, and the like.

In addition to the at least one transcriptionally active gene, the portion of the transposon containing the inverted repeats also comprises at least one restriction endonuclease recognized site, e.g. restriction site, located between the flanking inverted repeats, which serves as a site for insertion of an exogenous nucleic acid. A variety of restriction sites are known in the art and include, but are not limited to: HindIII, PstI, SalI, AccI, HincII, XbaI, BamHI, SmaI, XmaI, KpnI, SacI, EcoRI, and the like. In some embodiments, the vector includes a polylinker, i.e. a closely arranged series or array of sites recognized by a plurality of different restriction enzymes, such as those listed above. In other embodiments, the inserted exogenous nucleic acid could comprise recombinase recognition sites, such as LoxP, FRT, or AttB/AttP sites, which are recognized by the Cre, Flp, and PhiC31 recombinases, respectively.

Where the source of hyperactive transposase is a nucleic acid that encodes the hyperactive transposase, the nucleic acid encoding the hyperactive transposase protein is generally part of an expression module, as described above, where the additional elements provide for expression of the transposase as required.

The present invention also provides methods of integrating an exogenous nucleic acid into the genome of at least one cell of a multicellular or unicellular organism comprising administering directly to the multicellular or unicellular organism: a) a transposon comprising the exogenous nucleic acid, wherein the exogenous nucleic acid is flanked by one or more of any of the aforementioned inverted repeat sequences that are recognized by any of the aforementioned proteins; and b) any one of the aforementioned proteins to excise the exogenous nucleic acid from a plasmid, episome, or transgene and integrate the exogenous nucleic acid into the genome. In some embodiments, the protein of b) is administered as a nucleic acid encoding the protein. In some embodiments, the transposon and nucleic acid encoding the protein of b) are present on separate vectors. In some embodiments, the transposon and nucleic acid encoding the protein of b) are present on the same vector. When present on the same vector, the portion of the vector encoding the hyperactive transposase is located outside the portion carrying the inserted nucleic acid. In other words, the transposase encoding region is located external to the region flanked by the inverted repeats. Put another way, the tranposase encoding region is positioned to the left of the left terminal inverted repeat or to the right of the right terminal inverted repeat. In the aforementioned methods, the hyperactive transposase protein recognizes the inverted repeats that flank an inserted nucleic acid, such as a nucleic acid that is to be inserted into a target cell genome.

In some embodiments, the multicellular or unicellular organism is a plant or animal. In some embodiments, the multicellular or unicellular organism is a vertebrate. In some embodiments, the vertebrate animal is a mammal, such as for example, a rodent (mouse or rat), livestock (pig, horse, cow, etc.), pets (dog or cat), and primates, such as, for example, a human.

The methods described herein can be used in a variety of applications in which it is desired to introduce and stably integrate an exogenous nucleic acid into the genome of a target cell. In vivo methods of integrating exogenous nucleic acid into a target cell are known. The route of administration of the transposon system to the multicellular or unicellular organism depends on several parameters, including: the nature of the vectors that carry the system components, the nature of the delivery vehicle, the nature of the multicellular or unicellular organism, and the like, where a common feature of the mode of administration is that it provides for in vivo delivery of the transposon system components to the target cell(s). In certain embodiments, linear or circularized DNA, such as a plasmid, is employed as the vector for delivery of the transposon system to the target cell. In such embodiments, the plasmid may be administered in an aqueous delivery vehicle, such as a saline solution. Alternately, an agent that modulates the distribution of the vector in the multicellular or unicellular organism can be employed. For example, where the vectors comprising the subject system components are plasmid vectors, lipid-based such as a liposome, vehicles can be employed, where the lipid-based vehicle may be targeted to a specific cell type for cell or tissue specific delivery of the vector. Alternately, polylysine-based peptides can be employed as carriers, which may or may not be modified with targeting moieties, and the like (Brooks et al., J. Neurosci. Methods, 1998, 80, 137-47; and Muramatsu et al., Int. J. Mol. Med., 1998, 1, 55-62). The system components can also be incorporated onto viral vectors, such as adenovirus-derived vectors, sindbis-virus derived vectors, retrovirus-derived vectors, hybrid vectors, and the like. The above vectors and delivery vehicles are merely representative. Any vector/delivery vehicle combination can be employed, so long as it provides for in vivo administration of the transposon system to the multicellular or unicellular organism and target cell.

The elements of the PiggyBac transposase system are administered to the multicellular or unicellular organism in an in vivo manner such that they are introduced into a target cell of the multicellular or unicellular organism under conditions sufficient for excision of the inverted repeat flanked nucleic acid from the vector carrying the transposon and subsequent integration of the excised nucleic acid into the genome of the target cell. As the transposon is introduced into the cell "under conditions sufficient for excision and integration to occur," the method can further include a step of ensuring that the requisite PiggyBac transposase activity is present in the target cell along with the introduced transposon. Depending on the structure of the transposon vector itself, such as whether or not the vector includes a region encoding a product having PiggyBac transposase activity, the method can further include introducing a second vector into the target cell that encodes the requisite transposase activity, where this step also includes an in vivo administration step.

Because of the multitude of different types of vectors and delivery vehicles that can be employed, administration can be by a number of different routes, where representative routes of administration include, but are not limited to: oral, topical, intraarterial, intravenous, intraperitoneal, intramuscular, and the like. In some embodiments, the administering is administering systemically. The particular mode of administration depends, at least in part, on the nature of the delivery vehicle employed for the vectors that harbor the PiggyBac transposons system. In many embodiments, the vector or vectors harboring the PiggyBac transposase system are administered intravascularly, such as intraarterially or intravenously, employing an aqueous based delivery vehicle, such as a saline solution.

The amount of vector nucleic acid comprising the transposon element, and in many embodiments the amount of vector nucleic acid encoding the transposase, which is introduced into the cell is sufficient to provide for the desired excision and insertion of the transposon nucleic acid into the target cell genome. As such, the amount of vector nucleic acid introduced should provide for a sufficient amount of transposase activity and a sufficient copy number of the nucleic acid that is desired to be inserted into the target cell. The amount of vector nucleic acid that is introduced into the target cell varies depending on the efficiency of the particular introduction protocol that is employed, such as the particular in vivo administration protocol that is employed.

The particular dosage of each component of the system that is administered to the multicellular or unicellular organism varies depending on the nature of the transposon nucleic acid, e.g. the nature of the expression module and gene, the nature of the vector on which the component elements are present, the nature of the delivery vehicle and the like. Dosages can readily be determined empirically by those of skill in the art. For example, in mice where the PiggyBac transposase system components are present on separate plasmids which are intravenously administered to a mammal in a saline solution vehicle, the amount of transposon plasmid that is administered in many embodiments typically ranges from about 0.5 to 40 µg and is typically about 25 µg, while the amount of PiggyBac transposase encoding plasmid that is administered typically ranges from about 0.5 to 25 µg and is usually about 1 µg.

Once the vector DNA has entered the target cell in combination with the requisite transposase, the nucleic acid region of the vector that is flanked by inverted repeats, i.e. the vector nucleic acid positioned between the PiggyBac transposase-recognized inverted repeats, is excised from the vector via the provided transposase and inserted into the genome of the targeted cell. As such, introduction of the vector DNA into the target cell is followed by subsequent transposase mediated excision and insertion of the exogenous nucleic acid carried by the vector into the genome of the targeted cell.

The subject methods may be used to integrate nucleic acids of various sizes into the target cell genome. Generally, the size of DNA that is inserted into a target cell genome using the subject methods ranges from about 0.5 kb to 100.0 kb, usually from about 1.0 kb to about 60.0 kb, or from about 1.0 kb to about 10.0 kb.

The subject methods result in stable integration of the nucleic acid into the target cell genome. By stable integration is meant that the nucleic acid remains present in the target cell genome for more than a transient period of time, and is passed on a part of the chromosomal genetic material to the progeny of the target cell. The subject methods of stable integration of nucleic acids into the genome of a target cell find use in a variety of applications in which the stable integration of a nucleic acid into a target cell genome is desired. Applications in which the subject vectors and methods find use include, for example, research applications, polypeptide synthesis applications and therapeutic applications.

The present invention can be used in, for example, germline mutagenesis in a rat, mouse, or other vertebrate; somatic mutagenesis in a rat, mouse, or other vertebrate; transgenesis in a rat, mouse, or other vertebrate; and use in human gene therapy. In each of these, the hyperactive transposase can be delivered as DNA, RNA, or protein.

The hyperactive PiggyBac transposase system described herein can be used for germline mutagenesis in a vertebrate species. One method would entail the production of transgenic animals by, for example, pronuclear injection of newly fertilized oocytes. Typically, two types of transgenes can be produced; one transgene provides expression of the transposase (a "driver" transgene) in germ cells (i.e., developing sperm or ova) and the other transgene (the "donor" transgene) comprises a transposon containing gene-disruptive sequences, such as a gene trap. The transposase may be directed to the germline via a ubiquitously active promoter, such as the ROSA26 (Gt(ROSA)26Sor), pPol2 (Polr2a), or CMV/beta-actin (CAG) promoters. Alternately, one may use a germline-restricted promoter, such as the spermatid-specific Protamine-1 (Prm1) promoter, for mutagenesis exclusively in developing sperm. In another embodiment, the germline specific promoter is a female-specific promoter (e.g., a ZP3 promoter).

To achieve mutagenesis in this scenario, one can breed driver and donor transgenic lines to create double-transgenic animals. In double transgenic animals, which contain both transgenes in their genome, the PiggyBac transposase expressed in germ cells catalyzes the excision of the transposon and mediates mobilization to another site in the genome. If this new site contains a gene, then gene expression or protein production can be perturbed through a gene trap. The most effective gene traps consist of strong splicing signals, whereby disruption and creation of a null allele is mediated through a strong splice acceptor. A strong splice acceptor can also create alleles of altered function (such as a dominant negative, dominant active, or gain of function). Alternately, expression is rendered ectopic, constitutive, or altered through the use of a heterologous promoter and strong splice donor.

Mutagenesis occurs in the germline of double-transgenic animals (with both driver and donor transgenes) and upon breeding double-transgenic animals, mutant offspring with heritable and permanent mutations are produced. Mutations can be generated by injection of a fertilized oocyte with transposase RNA or protein. Alternatively, the transposase (as DNA, RNA, or protein) is electroporated, transfected or injected into embryonic stem cells, induced pluripotent stem cells, or spermatogonial stem cells. These mutations (transposon insertions) can be detected by, for example, Southern blot and PCR. The specific insertion sites within each mutant animal can then be identified by, for example, linker-mediated PCR, inverse PCR, or other PCR cloning techniques. Some of the mutant animals identified via PiggyBac-mediated mutagenesis can serve as valuable models for studying human disease.

Somatic mutagenesis is very useful for discovering tumor suppressors and oncogenes in a model vertebrate animal, such as the rat. Such experiments are otherwise not possible in humans, but through PiggyBac-driven mutagenesis, carcinogenesis can be triggered, much in the same way that ionizing radiation triggers carcinogenesis through DNA damage. With PiggyBac transposon-mediated insertional mutagenesis, however, mutations can easily be pinpointed through, for example, PCR cloning techniques. The mutations uncovered are often directly linked to the cancer, and in a single animal, hundreds of such mutations can be identified. This is incredibly valuable for linking specific genes as causative agents (tumor suppressors and oncogenes) that are directly involved in providing the growth and survival advantages inherent in a developing neoplasia.

For somatic mutagenesis, the transgenic strategy can be very similar to that for germline mutagenesis, except the driver transgene provides expression of the transposase in the tissue where carcinogenesis will be targeted. For example, the intestine-specific Villin (Vil1) promoter can provide highly specific expression of the PiggyBac transposase for targeted mutagenesis and carcinogenesis in the intestine and colon. This provides a valuable gene-discovery system of colon cancer in which oncogenes and tumor suppressors directly linked to colon cancer can be easily and rapidly identified. The donor transgene would likely be a bi-directional gene trap that can cause a loss of function, such as a null allele in either orientation, and a gain of function. The gain-of-function parameter is achieved through the use of a constitutive promoter, perhaps containing a strong enhancer sequence, which over-expresses a trapped oncogene. The resulting tumors from PiggyBac-mediated mutagenesis would likely contain both types of mutations, and thus both tumor suppressors and oncogenes can be uncovered.

For gene therapy to be practical, one should achieve stable integration of a therapeutic transgene in the genome of an afflicted tissue to provide a long-term and cost-effective treatment. Viruses provide effective gene delivery but are either highly immunogenic or carcinogenic. The PiggyBac transposon can mediate gene delivery in a target tissue with a much lower risk for immune reactions and cancer. The inherently low immunogenicity of the PiggyBac transposon is due to its simplicity; there are no coat proteins, no receptor molecules, and no extracellular components, but simply a single small enzyme that interacts with host factors to mediate transposon insertion. While the PiggyBac transposon shows a slight preference for inserting within genes, this preference is much less pronounced that a retrovirus, which has a very high preference for inserting within transcriptional units.

To achieve a high-efficiency and low-immunogenic gene transfer into patients, one can use synthetic compounds for delivering DNA into a cell. Liposomes and other nanoparticles are sufficient for this task. For PiggyBac-mediated gene therapy, two plasmids can be delivered to the patient: one that provides expression of the transposase (a driver plasmid), and another that provides the transposon containing a therapeutic transgene (the donor plasmid). These DNAs can be complexed with liposomes and administered via parenteral injection. Upon entering a cell the PiggyBac transposase may bind to the transposon in the donor plasmid, excise it, and then integrate it into the genome. Such insertions will be stable and permanent. The driver and donor plasmids will eventually be lost by cellular- and host-defense mechanisms, but any genome-integrated PiggyBac transposons, containing the therapeutic transgene, will be stable and permanent modifications. The transient nature of these plasmids also curtails excessive transposition, and thus minimizes the risk of carcinogenesis.

The present invention also provides methods of generating a transgenic, non-human vertebrate comprising in the genome of one or more of its cells a PiggyBac transposon which comprises nucleotide sequence that, when integrated into the genome, modifies a trait in the transgenic, non-human vertebrate, comprising: introducing ex vivo into a non-human vertebrate embryo or fertilized oocyte a nucleic acid comprising a PiggyBac transposon which comprises a nucleotide sequence that, when integrated into the genome, modifies a trait in the transgenic, non-human vertebrate, and, within the same or on a separate nucleic acid, a nucleotide sequence encoding a PiggyBac transposase; implanting the resultant non-human vertebrate embryo or fertilized oocyte into a foster mother of the same species under conditions favoring development of the embryo into a transgenic, non-human vertebrate; and, after a period of time sufficient to allow development of the embryo into a transgenic, non-human vertebrate, recovering the transgenic, non-human vertebrate from the mother; thereby generating a transgenic, non-human vertebrate comprising in the genome of one or more of its cells PiggyBac transposon.

The present invention also provides methods of mobilizing a PiggyBac transposon in a non-human vertebrate, comprising: mating a first transgenic, non-human vertebrate comprising in the genome of one or more of its germ cells a PiggyBac transposon, wherein the PiggyBac transposon comprises a nucleotide sequence, that when integrated into the genome, modifies a trait in the transgenic, non-human vertebrate, with a second transgenic, non-human vertebrate comprising in the genome of one or more of its germ cells a nucleotide sequence encoding a PiggyBac transposase to yield one or more progeny; identifying at least one of the one or more progeny comprising in the genome of one or more of its cells both the PiggyBac transposon and the nucleotide sequence encoding the PiggyBac transposase, such that the PiggyBac transposase is expressed and the transposon is mobilized; thereby mobilizing the PiggyBac transposon in a non-human vertebrate. The first and second transgenic, non-human vertebrates can be generated according to any of the methods described herein or known to those skilled in the art.

In some methods of transgenesis, transgenes are introduced into the pronuclei of fertilized oocytes. For some animals, such as mice fertilization is performed in vivo and fertilized ova are surgically removed. In other animals, particularly bovines, it is suitable to remove ova from live or slaughterhouse animals and fertilize the ova in vitro. In vitro fertilization permits a transgene to be introduced into substantially synchronous cells at an optimal phase of the cell cycle for integration (not later than S-phase). Transgenes are usually introduced by microinjection (see, U.S. Pat. No. 4,873,292). Fertilized oocytes are cultured in vitro until a pre-implantation embryo is obtained containing about 16-150 cells. Methods for culturing fertilized oocytes to the pre-implantation stage are described by, for example, Gordon et al., Methods Enzymol., 1984, 101, 414; Hogan et al., Manipulation of the Mouse Embryo: A Laboratory Manual, C.S.H.L. N.Y. (1986) (mouse embryo); Hammer et al., Nature, 1985, 315, 680; Gandolfi et al, J. Reprod. Fert., 1987, 81, 23-28; Rexroad et al., J. Anim. Sci., 1988, 66, 947-953; Eyestone et al., J. Reprod. Fert., 1989, 85, 715-720; Camous et al., J. Reprod. Fert., 1984, 72, 779-785; and Heyman et al., Theriogenology, 1987, 27, 5968. Pre-implantation embryos can be stored frozen for a period pending implantation. Pre-implantation embryos are transferred to an appropriate female resulting in the birth of a transgenic or chimeric animal depending upon the stage of development when the transgene is integrated. Chimeric mammals can be bred to form true germline transgenic animals. The PiggyBac transgenes described above are introduced into nonhuman mammals. Most nonhuman mammals, including rodents such as mice and rats, rabbits, sheep, goats, pigs, and cattle.

Alternately, transgenes can be introduced into embryonic stem cells (ES) or SS cells, or iPS cells, etc. These cells are obtained from preimplantation embryos cultured in vitro (Bradley et al., Nature, 1984, 309, 255-258). Transgenes can be introduced into such cells by electroporation or microinjection. Transformed ES cells are combined with blastocysts from a nonhuman animal. The ES cells colonize the embryo and in some embryos form the germ line of the resulting chimeric animal (Jaenisch, Science, 1988, 240, 1468-1474).

Alternately, ES cells can be used as a source of nuclei for transplantation into an enucleated fertilized oocyte giving rise to a transgenic mammal.

For production of transgenic animals containing two or more transgenes, such as in embodiments where the Piggy-Bac transposon and PiggyBac transposase components of the invention are introduced into an animal via separate nucleic acids, the transgenes can be introduced simultaneously using the same procedure as for a single transgene. Alternately, the transgenes can be initially introduced into separate animals and then combined into the same genome by breeding the animals. Alternately, a first transgenic animal is produced containing one of the transgenes. A second transgene is then introduced into fertilized ova or embryonic stem cells from that animal.

Transgenic mammals can be generated conventionally by introducing by microinjecting the above-described transgenes into mammals' fertilized eggs (those at the pronucleus phase), implanting the eggs in the oviducts of female mammals (recipient mammals) after a few additional incubation or directly in their uteri synchronized to the pseudopregnancy, and obtaining the offspring.

To find whether the generated offspring are transgenic, many procedures, such as dot-blotting, PCR, immunohistological, complement-inhibition analyses, and the like, can be used.

The transgenic mammals generated can be propagated by conventionally mating and obtaining the offspring, or transferring nuclei (nucleus transfer) of the transgenic mammal's somatic cells, which have been initialized or not, into fertilized eggs of which nuclei have previously been enucleated, implanting the eggs in the oviducts or uteri of the recipient mammals, and obtaining the clone offspring.

Transformed cells and/or transgenic organisms, such as those containing the DNA inserted into the host cell's DNA, can be selected from untransformed cells and/or transformed organisms if a selectable marker is included as part of the introduced DNA sequences. Selectable markers include, for example, genes that provide antibiotic resistance; genes that modify the physiology of the host, such as for example green fluorescent protein, to produce an altered visible phenotype. Cells and/or organisms containing these genes are capable of surviving in the presence of antibiotic, insecticides or herbicide concentrations that kill untransformed cells/organisms or producing an altered visible phenotype. Using standard techniques known to those familiar with the field, techniques such as, for example, Southern blotting and polymerase chain reaction, DNA can be isolated from transgenic cells and/or organisms to confirm that the introduced DNA has been inserted.

In order that the invention disclosed herein may be more efficiently understood, examples are provided below. It should be understood that these examples are for illustrative purposes only and are not to be construed as limiting the invention in any manner. Throughout these examples, molecular cloning reactions, and other standard recombinant DNA techniques, were carried out according to methods described in Maniatis et al., Molecular Cloning—A Laboratory Manual, 2nd ed., Cold Spring Harbor Press (1989), using commercially available reagents, except where otherwise noted.

EXAMPLES

Example 1

Using a MoMuLV System of Transduction for Screening Variants

In many ways, an efficient retroviral method of transduction is ideal for screening individual mutants within a single cell. Retroviral vectors derived from the MoMuLV retrovirus contain elements for expression and packaging of the RNA genome, but lack genes that enable replication. These vectors contain viral long terminal repeats (LTRs), a psi packaging signal that regulates encapsidation of the RNA, a site for cloning the cDNA of interest, and typically, a selectable marker such as the neomycin phosphotransferase gene (Neo). These viral vectors are transfected (as plasmid DNA) into a special packaging cell line that expresses genes necessary for encapsidation of the RNA genome into infectious virions. The virus is then harvested by collecting the supernatant from transfected packaging cells. Upon infecting a susceptible target cell one or more viral particles fuse with the cell membrane and are uncoated. The nucleocapsid (uncoated virion) enters the nucleus, where it is reverse-transcribed into DNA, and integrates into the genome as a permanent proviral insertion. Since the LTRs of viral vectors act as a strong promoter in many cells, the cDNA of choice is expressed. The proviral insertion cannot produce more infectious virus particles.

If one produces a cDNA library within a retroviral vector, one can assess the function of distinct cDNAs in individual cells containing proviral insertions. This can be accomplished through transient transfection of a packaging cell line to produce a retroviral library. During a transient transfection, individual cells may have thousands of different retroviral vectors, but each virion produced contains two identical copies of the same RNA (Flynn et al., J. Virol., 2004, 78, 12129-39; and Flynn et al., Virology, 2006, 344, 391-400). If one generates a retroviral library containing $10^7$ cfu per ml, then millions of target cells can be infected with one ml of viral supernatant such that each cell, on average, is infected with one virion. This would represent a multiplicity of infection (MOI) of one. This allows one to screen millions of cDNA variants as single proviral insertions within each cell. The true power of a diverse high-titer retroviral library is reflected in the efficiency of gene delivery to individual target cells.

Example 2

Screening Large Libraries of Variants

Large libraries of DNA fragments, with greater than $10^{10}$ variants, are easily produced through error-prone PCR methods or polymerase/DNase-based recombination methods. Because of the development of new ultra-efficient strains of electrocompetent E. coli, about $10^6$ to $10^7$ variants can be amplified from ligated plasmid DNA. A difficulty lies in creating a cell-based biological system that can then individually screen each mutant. The methods described herein enables one to screen of millions of transposase variants. This process is facilitated by the improved efficiency of MoMuLV vectors and virus packaging lines. A packaging line derived from 293T cells, termed Platinum-E (Plat-E), which produces high-titer virus (>$10^7$ cfu/ml) from transiently transfected plasmid DNA is used herein (Morita et al., Gene Ther., 2000, 7, 1063-6). Transient transfection is desired to maintain library diversity. The level of efficiency of the Plat-E cell lines is achieved through enhanced expression of the gag-pol and env retroviral genes in a cell-line (293T) that is easily transfected at high efficiency. This cell line out-performs two previously designed packaging cell lines, Bosc23 and Phoenix-Eco. The Plat-E cell line produces replication-defective ecotropic viruses, which only infect mouse and rat cells via the ecotropic retroviral receptor, and are, thus, quite safe.

While reagents and techniques allow the generation of large diverse retroviral libraries, each distinct variant should be easily discriminated in an appropriate cell-based assay. For selection of a hyperactive transposase, one would want to select a transposase that can rapidly and efficiently mobilize a transposon from one genomic location to another. Thus, for a given experimental period a hyperactive transposase should yield a greater number of transposon integrations per cell vs. a mediocre transposase. Described herein is a special transposon-based selection system, which when integrated, yields either: 1) a green fluorescent protein (GFP) signal proportional to the number of integrations per cell, or 2) variable resistance to the toxic alkaloid colchicine, which is likewise proportional to the number of integrations per cell.

Example 3

Measuring Transposase Activity Through Copy-Number Dependent Expression

To assay the activity of transposase variants within each library, the intensity of GFP fluorescence as a read-out of transposase efficiency was used. This can be accomplished by using polyA-trap genetrap transposons, which have been constructed. Two versions of the transposon have been created, each containing the PiggyBac ITRs recognized by the PiggyBac transposase, termed BII-sd2GFP and BII-sMdr1 (see, FIG. 1). These genetraps express either a destabilized GFP (d2GFP) or human multidrug resistance gene (Mdr1 or ABCB1) upon integration within a gene and upstream of a polyadenylation (polyA) signal, and has been designed to yield copy-number dependent expression. Thus, a hyperactive transposase drives the insertion of multiple copies of the transposon, yielding more GFP signal or a higher Mdr1 gene dosage. The GFP protein is destabilized by a C-terminal PEST domain, which causes rapid turnover. This yields a larger dynamic range for measuring copy-number dependent expression of GFP; this allows one to easily discriminate between low-expressors (low copy-number) and high-expressors (high copy-number). High copy number transposition events of the BII-sMdr1 transposon is achieved through stringent drug selection with the microtubule-depolymerizing toxic alkaloid called colchicine. Higher doses of colchicine require concomitantly greater expression levels of Mdr1 for cell survival (Kane et al., Gene, 1989, 84, 439-46; Kane et al., Mol. Cell. Biol., 1988, 8, 3316-21; and Kane et al., Biochem. Pharmacol., 2001, 62, 693-704). Mdr1 is a glycoprotein transporter that confers resistance to a variety of drugs, including chemotherapeutic compounds, by reducing intracellular levels of the drug (Metz et al., Virology, 1995, 208, 634-43; Pastan et al., Proc. Natl. Acad. Sci. USA, 1988, 85, 4486-90; and Ueda et al., Proc. Natl. Acad. Sci. USA, 1987, 84, 3004-8).

Copy number-dependent expression of the polyA trap is conferred by several additional components. Within the transposon, the reporter (GFP or Mdr1) is driven by a constitutive promoter that lacks CpG dinucleotides, and thus cannot be silenced by methylation. In addition, the genetrap is flanked by the core insulator from the chicken beta-globin locus control region hypersensitive site IV (cHSIV) (Burgess-Beusse et al., Proc. Natl. Acad. Sci. USA, 2002, 99, 16433-7; Chung et al., Proc. Natl. Acad. Sci. USA, 1997, 94, 575-80; and Chung et al., Cell, 1993, 74, 505-14). The cHSIV insulator insulates against any adjacent enhancers to reduce variability in expression (enhancer-blocking activity). This cHSIV element also prevents the encroachment of gene-silencing heterochromatin (insulator activity) that could silence expression (Burgess-Beusse et al., Proc. Natl. Acad. Sci. USA, 2002, 99, 16433-7; Chung et al., Proc. Natl. Acad. Sci. USA, 1997, 94, 575-80; and Chung et al., Cell, 1993, 74, 505-14).

These properties confer copy number-dependent expression of an integrated transgene. However, because this genetrap lacks a polyA signal, the reporter only generates a stable transcript following integration into a gene. The polyA trap components include an internal ribosomal entry site (IRES) from the encephalomyocarditis virus downstream of the GFP/Mdr1 open reading frame (ORF). The IRES prevents degradation of hybrid mRNA species expressed following a polyA trap event, which occurs through a poorly understood process called nonsense mediated mRNA decay (Shigeoka et al., Nucleic Acids Res., 2005, 33, e20). Immediately following the IRES is a splice donor (SD) from the exon1/intron1 boundary of the adenovirus type 2 (Ad2) late major transcript, which enables the reporter transcript to splice with the splice acceptor of a trapped exon. To prevent expression of integrations that do not occur within a multi-exon gene, an mRNA instability signal from the 3' untranslated region (UTR) of the mouse Csf3 gene was also included, which causes active deadenylation and degradation of the mRNA transcript. The use of an mRNA instability signal from the Csf3 gene was effectively employed for reducing transcript levels in a previous design of a polyA trap (Ishida et al., Nucleic Acids Res., 1999, 27, e35).

All of these components prevent any significant expression prior to mobilization (or upon mobilization into intergenic regions distal to splice acceptors and polyA signals) but permits expression when integration occurs within genes, in a copy number-dependent manner. Prior to mobilization the transposon can be introduced into cells in two manners: 1) as a multi-copy tandem array (concatemer) integrated into the genome of cells at an intergenic region (where the polyA trap does not have any genes nearby for splicing and transcript stabilization) or 2) as a transfected circular plasmid.

For the BII-sd2GFP transposon one can easily distinguish the absence of (or weak) GFP expression produced by an unmobilized transposon from the increased GFP expression that occurs when the transposon integrates into a gene. Fluorescence is therefore a surrogate marker of transposase activity and enables cell sorting by FACS. The efficient mobilization of the BII-sMdr1 transposon is easily screened by treating cells with increasing amounts of colchicine; only PiggyBac transposases that can mobilize multiple copies of the BII-sMdr1 transposon are isolated following stringent selection with high doses of colchicine. Those cells exhibiting a high level of GFP fluorescence or tolerating high doses of colchicine can then be collected.

Referring to FIG. 1, these transposons contain components for driving expression of either the destabilized GFP (d2GFP) or human Mdr1 protein upon insertion within a gene, and upstream of a polyadenylation signal. Expression of either cDNA is driven by a CpG-less promoter that consists of a mouse cytomegalovirus (CMV) enhancer and a basal promoter from the human Ef1α gene. Downstream of the d2GFP or Mdr1 cDNA is an IRES that prevents non-sense mediated decay of hybrid transcripts. The splice donor (SD) is from the human Adenovirus type 2 late major transcript, and efficiently permits splicing with 3' trapped exons. An mRNA instability signal from the Csf3 gene (zigzag) minimizes transcript levels when no polyA trap occurs. The chicken hypersensitive site IV (cHSIV) from the beta globin locus provides enhancer-blocking activity and insulation from adjacent heterochromatin, which promotes consistent copy-number dependent expression. The inverted terminal repeats (ITRs, arrows) from the PiggyBac transposons are recognized and provide mobilization by the respective transposases.

In some embodiments, five individual PB mutations were assessed for transpositional activity in a flow-cytometry based assay in which EGFP fluorescence serves as a read-out of transposition into the genome as described below. One PB mutation, M226F, yielded a greater than 2-fold increase in the number of EGFP-positive cells.

To select for high levels of transposase activity, a high-throughput fluorescent activated cell-sorting (FACS) assay that measures the intensity of EGFP fluorescence as a read-out of transposase efficiency was developed. This was accomplished by using a polyA-trap genetrap transposon, called the sEGFP transposon, which was constructed at Transposagen (see, FIG. 2A). sEGFP transposons were created that are flanked by the PB, inverted terminal repeats (ITRs). This genetrap expresses EGFP upon integration within a gene and upstream of a polyadenylation (polyA) signal, and has been designed to yield copy-number dependent expression. Thus, in principle, a hyperactive transposase will drive the insertion of multiple copies of the transposon, yielding more EGFP expression, and thus a brighter fluorescence signal. Copy number-dependent and polyA-dependent expression is conferred by several additional components (see, FIG. 2A).

Figure 2:
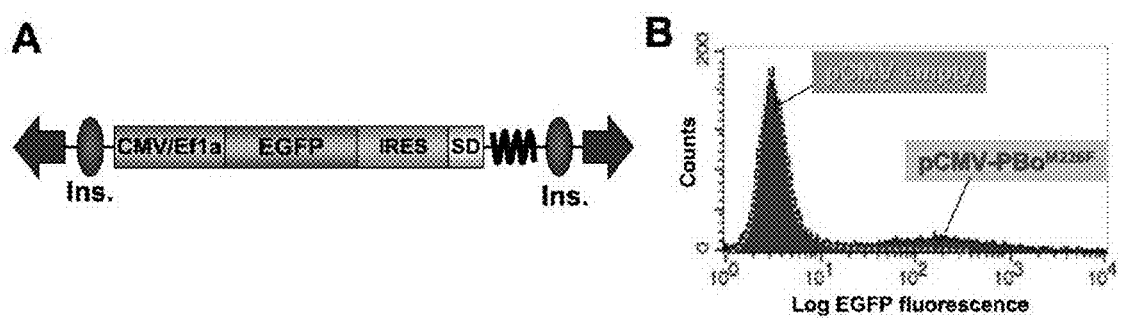
FIG. 2 shows a representative transposition analysis by FACS.

Referring to FIG. 2A, the sEGFP Poly-A trap transposon is shown. Expression of the EGFP cDNA is driven by a CpG-less promoter (consisting of a mouse cytomegalovirus (CMV) enhancer and a basal promoter from the human Ef1α gene). Downstream of the EGFP ORF is an IRES that prevents non-sense mediated decay of hybrid transcripts following a successful genetrap event. The splice donor (SD) is from the human Adenovirus type 2 late major transcript, and permits efficient splicing when integration occurs 5' of an exon. An mRNA instability signal from the Csf3 gene (zigzag) destabilizes untrapped transcripts. The cHSIV insulator (blue ovals) promotes consistent copy-number dependent expression. The inverted terminal repeats (ITRs, arrows) from the SB, TniPB, or TcB transposons provide mobilization by the respective transposases. Referring to FIG. 2B, FACS analysis is shown. $2.5 \times 10^6$ NIH3T3 cells were electroporated with 2.5 µg of the sEGFP transposon flanked by piggyBac ITRs, along with 1.5 µg of an expression plasmid containing a PB transposase (pCMV-PBoM226F) or an empty vector (pCMV empty), and then assayed by flow cytometry 72 hours later. Most EGFP$^+$ cells were between 10- to 100-fold below the detection maximum.

Example 4

Identifying Rational Substitutions within the PiggyBac Transposase

To determine the phylogenetic deviation of the PiggyBac transposases, PiggyBac-like polypeptide sequences from the following species (with the indicated GenBank accession numbers) were analyzed for phylogenetic comparison: *Trichoplusia ni* (AAA87375.2), *Xenopus tropicalis* (BAF82022.1), *Bombyx mori* (BAD11135.1), *Heliothis virescens* (ABD76335.1), *Macdunnoughia crassigna* (ABZ85926.1), *Strongylocentrotus purpuratus* (XP_797885.2), *Culex pipiens quinqefasciatus* (XP_001869225.1), *Daphnia pulicaria* (AAM76342.1), *Helicoverpa armigera* (ABS18391.1), *Danio rerio* (XP_699416.2), *Nasonia vitripennis* (XP_001599370.1), *Bactrocera dorsalis* (AF289123), *Takifugu rubripes* (scaffold_270, 208447-210099), *Danio rerio* (XP_699416.1), *Gasterosteus aculeatus* (Chr:groupXX, 10624991-10626727), *Ciona savignyi* (reftig_140, 9946-11658), *Ciona intestinalis* (NW_001955008.1, 51209-52888, and NW_001955804.1, 1016-2667), *Anopholes gambiae* (NZ_AAAB02008849, 2962684-2964410), *Tribolium castaneum* (NW_001092821.1, 1981685-1983397), and *Myotis lucifugus* (GeneScaffold_410, 157651-159369). These elements represent invertebrate and vertebrate PiggyBac-like transposases that each contains a critical DDD motif (D268, D346, D447) and a tryptophan residue (W465), which are all necessary for *Trichoplusia ni* PiggyBac enzyme activity. Protein sequences were aligned by the ClustalW method. Individual amino acid positions of the PiggyBac transposase sequence were deemed divergent if no more than five PiggyBac-like sequences (from species other than *Trichoplusia ni*) shared the PiggyBac amino acid (or highly-similar amino acid) with *Trichoplusia ni* (*T. ni*) at a given position, when no fewer than seven non-*T. ni* transposases contained the identical (or highly-similar) amino acid for that position. Such commonly shared amino acids at a given position among these PiggyBac-like transposases represent a "consensus" amino acid sequence. In addition, at least twice as many species must contain the consensus amino acid, compared to the number of species (including *T. ni*) that share an identical non-consensus amino acid. The rational substitution of individual amino acids was deduced from divergent positions, such that PiggyBac sequences were reverted, or restored, to the consensus. These rational substitutions are illustrated along a schematic of the PiggyBac transposase protein in FIG. 3A and FIG. 4A.

Example 5

Generating Diverse Permutations of the Rational Substitutions

Figure 3:
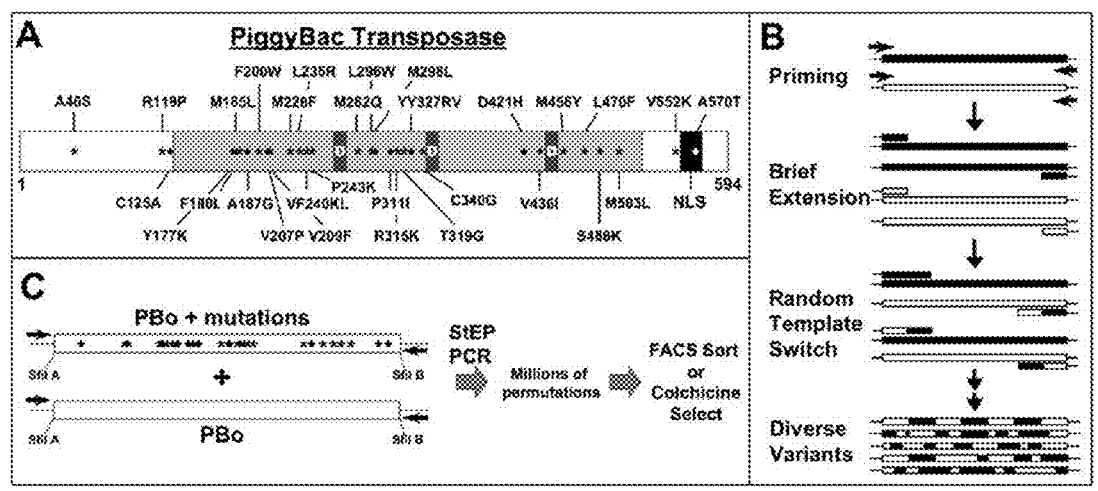
FIG. 3 shows representative description of hyperactive transposases.
Figure 4:
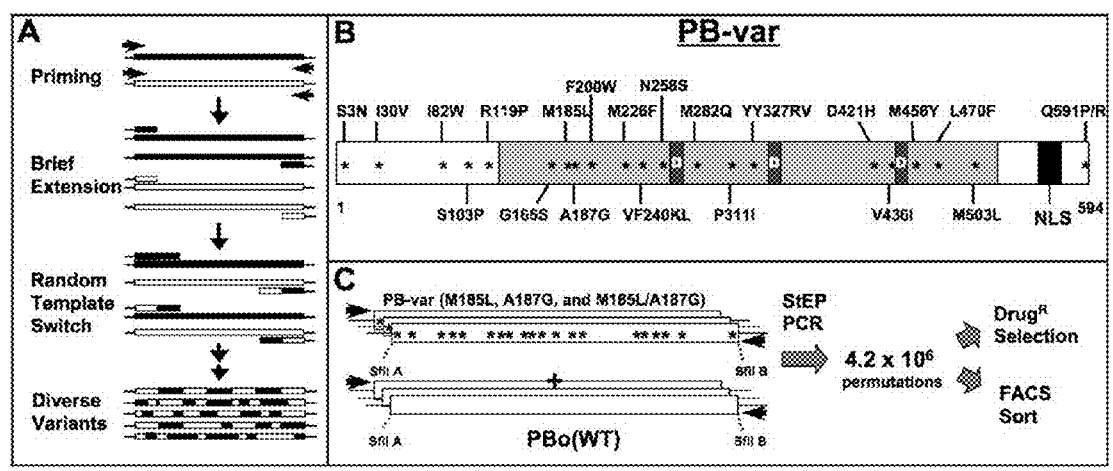
FIG. 4 shows another representative description of hyperactive transposases.

To assess the interaction and possible cooperation between these rational substitutions, a method called the staggered extension process (StEP), a PCR-based DNA recombination strategy entailing frequent template switching, was used. StEP creates random permutations of two closely related sequences through template switching, made possible by allowing only brief periods of primer extension (FIG. 3B). A diverse collection of variants is obtained after many cycles of priming, extension, and template switching. The StEP method is employed to shuffle two templates: (1) a codon-optimized PiggyBac transposase (PBo) sequence containing some or all of these 32 rational substitutions (termed PB-var) along with (2) a codon-optimized (PBo) cDNA sequence that codes for the wild type *T. ni* PiggyBac amino acid sequence (FIG. 3C). For StEP, equimolar concentrations of the PBo and the PB-var DNA are combined in 8 to 12 separate reactions containing a primer pair that flanks two unique SfiI sites and the PiggyBac transposase sequence. To minimize mutations introduced by PCR and keep diversity limited to the described substitutions, Phusion (NEB) high fidelity polymerase was used. Thermocycling uses this program: 98° C. for 60 seconds, 98° C. for 15 seconds, and 56° C. for 5 seconds, for 198 cycles. The short 56° C. step incorporates primer annealing and a very brief period of polymerase extension, producing small fragments, which after denaturation then randomly anneals to homologous regions (template switching). 198 cycles are desired to generate full-length hybrid fragments at a length of 2 Kb. To eliminate the original plasmid DNA, which is dam-methylated at GATC sites, PCR reactions are digested with DpnI, run on a 1% agarose gel, extracted, pooled, and if DNA yield is too low, a standard high-fidelity PCR is performed on this template. DNA is digested with SfiI and ligated into the retroviral expression vector pLXIN (Clontech) that has been modified by adding two unique and compatible SfiI sites. This ligation is then purified by agarose gel electrophoresis and 50 to 100 ng of DNA is electroporated each into 4 aliquots of DH10B Mega-X (Invitrogen) electrocompetent cells, then recovered by shaking at 37° C. for 45 minutes. Serial dilutions (10-2, 10-3, 10-4) of each transformation are plated onto LB-Ampicillin to determine the number of colony forming units (cfu) per ml and to estimate potential diversity. Approximately $5\times10^6$ cfu from the library is then amplified in semi-solid LB agar and DNA isolated using the Pure Yield Plasmid Midiprep Kit (Promega). Prior to DNA isolation, a small aliquot of the amplified transformation is plated on LB agar plus Ampicillin, and 24 colonies picked and sequenced to assess diversity and recombination frequency between each substitution.

A schematic describing the PB mutations is shown in FIG. 4B; this PB-var sequence was shuffled with a wildtype PBo sequence. After shuffling, DNA libraries were ligated via directional SfiI sites into a modified pLXIN (Clontech) vector. Following transformation of each library into Mega-X electrocompetent DH10B cells (Invitrogen), $5\times10^6$ cfu were amplified for the PB library, in semi-solid agar. Plasmid DNA was isolated and used to transfect Platinum-E cells for retrovirus production.

Upon cloning into a retroviral vector, transduction of the library into NIH-3T3 cells enables each individual transposase to be assayed in a single cell, if one adjusts the multiplicity of infection (MOI) such that each cell receives, on average, one functional proviral insertion. A hyperactive transposase will drive the mobilization of multiple transposon insertions per cell. The sEGFP transposon, which is capable of driving copy-number dependent expression, serves as a surrogate read-out of transposase efficiency, as determined by the intensity of EGFP fluorescence. Transduced cells expressing a library of variants can thus be functionally sorted using FACS. An alternate strategy by selecting for puromycin-resistance using a transposon that contains a puromycin acetyltrasferase (PAC) expression cassette, called BII-SVPuro (for PB), was also devised. The PAC expression cassette also contains SV40 promoter/enhancer and polyadenylation (pA) signals. After the library screens, the proviral insertion can then be PCR amplified from genomic DNA from these sorted cells, and a secondary library generated. By repeating this process, one can enrich for the most hyperactive variants.

Referring to FIG. 4A, the PiggyBac transposase with alterations spread throughout the polypeptide sequence; mutations include single amino acid substitutions and two double amino acid substitutions (VF240KL and YY327RV). The nuclear localization signal (NLS, black box) is located at the C-terminus of the polypeptide. The catalytic domain (shaded gray) spans a large central core, and contains the catalytic DDD box, which is highlighted in red. Referring to FIG. 4B, StEP PCR entailed successive rounds of brief polymerization, followed by denaturation, and template switching through promiscuous annealing. Referring to FIG. 4C, shuffling between two PiggyBac transposase sequences was accomplished by combining the wild-type PBo sequence with a mutated sequence (containing various substitutions) followed by a PCR amplification with very brief periods of polymerase activity (StEP PCR). Template switching produces multiple iterations, and thus, a collection of diverse variants.

Referring again to FIG. 4, two substitutions were planned at position 591 (Q591P or Q591R), but ultimately the Q591R substitution was discarded. Essential aspartates (red) residues make up the catalytic DDD box. The nuclear localization signal (NLS, black box) is located near the C-terminus. Equal amounts of two templates (1 part M185L, 1 part A187G, and 1 part M185L/A187G versions of PB-var) and 3 parts WT PBo were combined and StEP PCR produced shuffled sequences. PCR products were digested with SfiI to create a retroviral library to be ultimately screened by drug resistance selection or FACS.

Example 6

Creating and Screening the Retroviral Library

After diversity has been evaluated and the library has been amplified, Plat-E packaging cells (Cell Biolabs) in 10 cm dishes are transiently transfected with 7.5 µg of the amplified and purified plasmid library using LipoD293 Transfection Reagent (SignaGen). Viral supernatant is then collected 48 hours later, gently filtered through a 0.45 µm filter, and mixed with polybrene (8 µg/ml final concentration). Viral titers are assessed by infecting NIH-3T3 cells with serial dilutions ($10^{-1}$, $10^{-2}$, $10^{-3}$, $10^{-4}$, $10^{-5}$, $10^{-6}$) of the viral supernatant in 6-well plates. A titer between $5\times10^5$ and $1\times10^7$ cfu/ml is typical.

To assay the activity of variants within each library, GFP intensity as a surrogate marker of transposase efficiency is used. First, the BII-sd2GFP transposon is integrated into the genome of NIH-3T3 cells as a concatemer repeat, to establish a source of the transposon in a native chromatin environment. This is a standard procedure accomplished by transfecting NIH-3T3 cells with the BII-sd2GFP transposon along with one-tenth (molar ratio) the amount of a plasmid containing a puromycin or hygromycin selectable marker. Stable lines are selected by picking individual drug-resistant colonies that are not GFP-positive, as assessed by examination under an inverted fluorescent microscope. The copy number of the sd2GFP transposon can then be evaluated by quantitative PCR (QPCR). Clones with at least 25 copies are retained for further study. Each cell line is then evaluated for transposition by transfection of an expression vector containing the PB transposase. Successful mobilization of the BII-sd2GFP transposon is then evaluated by flow cytometry on a Becton Dickinson FACScaliber (BD Biosciences).

Retroviral libraries are then used to infect approximately $5\times10^6$ NIH-3T3-sd2GFP cells at an MOI of one. After 8 hours, the medium is changed, and after 16 hours the medium is changed again, and then incubated for an additional 48 hours. Cells are sorted for the brightest GFP fluorescence (if at least 100-fold over background) on a FACSVantage SE (BD Biosciences). Genomic DNA is isolated from these cells and the transposase coding sequence within proviral insertions is amplified by PCR using Phusion polymerase (NEB). PCR products are digested with SfiI and ligated into the pLXIN retroviral vector and a second retroviral library produced again as above. This first generation (G1) retroviral library is used to infect NIH-3T3-sd2GFP cells and the process repeated (in triplicate) to produce subsequent generations (G2, G3, and up to G4, with three preparations/sorts per generation) until a library yields homogenous hyperactivity as assessed by FACS. A refining process occurs through this repeated cycling, which culminates in a small collection of hyperactive transposases. No more than four generations are analyzed.

Proviral insertions from the final population of sorted cells are amplified by PCR and clones sequenced to identify each hyperactive transposase. The hyperactivity of isolated PB transposases is then compared to wildtype *T. ni* PBo by FACS assays in HEK293T cells and in a chromosomal transposition assay in HeLa cells (Baus et al., Molecular Therapy, 2005, 12, 1148-1156; Ivics et al., Cell, 1997, 91, 501-10; Zayed et al., Mol. Ther., 2004, 9, 292-304; and Yant et al., Mol. Cell. Biol., 2004, 24, 9239-47). In the chromosomal transposition assay, a Neo cassette in the transposon confers G418-resistance while the transposase is expressed from a separate plasmid.

Example 7

Initial Screening of the Primary (G0) Shuffled Transposase Libraries

To screen PB libraries using the transposons containing the PAC expression cassettes, approximately $1.2 \times 10^7$ NIH-3T3 cells were electroporated with the respective SVPuro transposon and split between four T175 flasks. Twenty-four hours after electroporation, cells were infected with the PB retroviral libraries. Puromycin selection yielded hundreds of thousands of surviving cells from each library. In the absence of transposase expression (i.e., following infection with a virus lacking a transposase open reading frame), no cells survived puromycin selection. After four days of selection with puromycin, genomic DNA was isolated and the provirus was PCR amplified with Phusion Hot Start (Finnzymes) using primers that flank the unique pair of SfiI sites adjacent to the coding region of the transposase. The amplified transposases were subcloned into the pLXIN vector for production of the secondary (G1) transposase libraries. The generation of a G1 library for the PB transposase was accomplished. Table 1 shows a quantitative summary of the current stage of screening for the primary (G0) and secondary (G1) libraries.

TABLE 1

| # of Shuffled Mutations | Possible # of Iterations | # of Clones Amplified (G0 library) | G0 Retroviral Library Titer (cfu/ml) | # of Clones Amplified (G1 library) | G1 Retroviral Library Titer (cfu/ml) |
|---|---|---|---|---|---|
| 21 | $2.1 \times 10^6$ | $5 \times 10^6$ | $3 \times 10^6$ | $2.1 \times 10^6$ | $5 \times 10^5$ |
| 13 | 8,192 | $1 \times 10^6$ | $8 \times 10^6$ | No data | No data |

Example 8

Production of Hyperactive PB Transposases (M185L, A187G)

Figure 5:
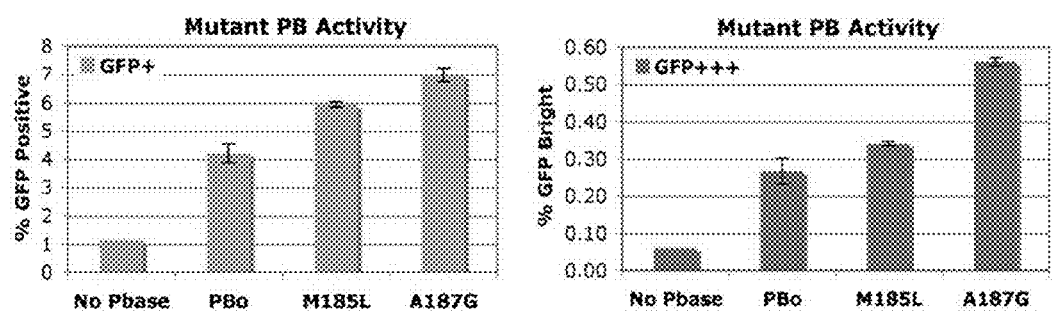
FIG. 5 shows representative flow-cytometry assay of some hyperactive transposases.

Using phylogenetic conservation to suggest rational substitution, two mutant PiggyBac transposases, M185L and A187G, which each demonstrate hyperactivity in a FACS-based transposition assay, have been generated and tested. The activity of these mutant transposases with the polyA-trap transposon, BII-sEGFP, which is similar to the BII-sd2GFP transposon except an enhanced (non-destabilized) GFP (EGFP) coding sequence has been substituted for the d2GFP sequence, is illustrated herein. The EGFP protein enables more sensitive detection of single transposition events in single cells. HEK293T cells were transfected with plasmids containing the PB transposon (BII-sEGFP) and each mutant PB transposase. Approximately $3 \times 10^5$ HEK293T cells were transfected in 6-well plates with calcium-phosphate and the GFP fluorescence was analyzed 72 hours later by FACS (FIG. 5). With the wild-type codon-optimized PB (PBo) transposase, about 4% of cells are GFP-positive, whereas only about 1% are positive without the transposase (FIG. 5A). If only GFP+++ "bright" cells, which exhibit at least 100-fold greater fluorescence over background, are examined then this difference is more pronounced, with about 5-fold more GFP "bright" cells produced versus the wild-type PBo transposase. The mutant PiggyBac transposases, M185L and A187G, yield increased mobilization of the BII-sEGFP transposon, as measured by the number of GFP positive cells (FIG. 5). The M185L mutant produces about 50% more GFP+ cells (FIG. 5A), and about 30% more GFP+++ cells (FIG. 5B), compared to wild-type PBo. The A187G mutant produces approximately 70% more GFP+ cells (FIG. 5A), and about 100% more GFP+++ cells (FIG. 5B), compared to wild-type PBo. These assays illustrate an increased ability of these mutant transposases to mobilize the BII-sEGFP transposon. This hyperactivity could be due to an enhanced stability of the transposase, an increase in the catalytic efficiency, and/or an augmented preference for integration within genes (which would yield more GFP signal). Any of these features would be desirable for performing mutagenesis in vertebrate or mammalian cells.

Referring to FIG. 5A, flow cytometry assay measuring GFP fluorescence produced when the polyA-trap transposon (BII-sEGFP) inserts into the genome, upstream of a polyadenylation signal. Without the tranposase (No Pbase), very few fluorescent cells were observed, whereas the wild-type PBo produces a four-fold increase in GFP+ cells. The M185L and A187G mutant transposases exhibited enhanced activity, yielding a six and seven-fold increase, respectively, in the number of GFP-positive cells. Referring to FIG. 5B, a similar trend was observed when examining GFP+++ "bright" cells, which exhibited at least 100-fold greater GFP fluorescence over background. Remarkably, the A187G mutant PB transposase yielded approximately 10-times as many GFP+++ cells than the "No Pbase" control, and 2-times as many GFP+++ cells as the wild-type PBo transposase.

Example 9

Identification of Hyperactive PB Mutations

Figure 6:
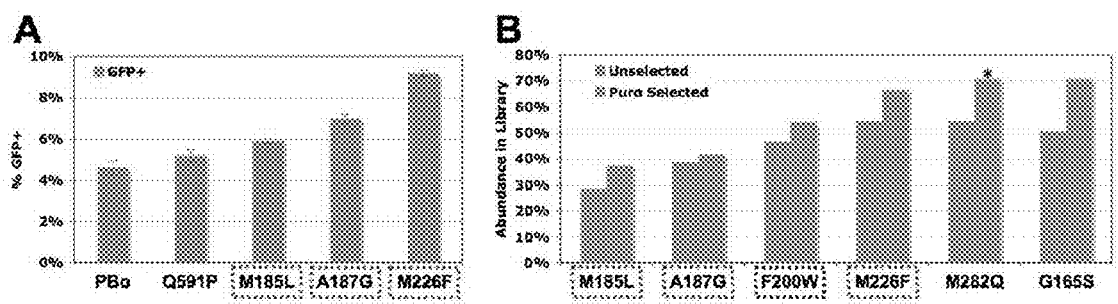
FIG. 6 shows identification of hyperactive transposases by flow-cytometry analysis.

Several individual mutations were characterized for their ability to confer hyperactivity to the PB transposases: Q591P, M185L, A187G, and M226F. Quantification of transposition by the flow cytometry assay in HEK293T cells revealed that all of these mutations conferred some degree of hyperactivity, with the M226F yielding over 2-fold greater number of GFP-positive cells (FIG. 6A). The M226F mutation also yielded nearly twice the mean fluorescence of all gated cells, as compared to wildtype PBo (not shown), suggesting that the number of insertions mobilized, per cell, was greater for PBoM226F.

The primary (G0) library for PB was initially screened for the ability to mobilize a PB transposon containing a PAC expression cassette (BII-SV-Puro), which confers puromycin resistance in NIH-3T3 cells. 24 clones from the ensuing G1 library were sequenced to glean some idea of mutation abundance. In the unselected library (G0), the sequence of 77 clones was observed; the abundance of most mutations was close to 50%, as expected, except for M185L and A187G, which were expected to be present in 33% of all variants due to our strategy for manually shuffling these particular mutations (FIG. 6B). Comparison of the G0 and G1 clones revealed that the M185L, A187G, F200W, M226F, M282Q, and G165S mutations were the six most-enriched mutations among all 21 shuffled substitutions. The F200W mutation, while not yet functionally assessed for hyperactivity, was one of the two most strongly suggested rational substitutions, by phylogeny (a tryptophan was observed at position 200 for 15 out of 20 aligned PB transposases). While the sampling size is incredibly small for the analysis of a large library, the enrichment of three out of four known hyperactive mutations appears very significant (FIG. 6B). In addition, restriction digest analysis with BsrGI, which is diagnostic for the M282Q mutation, revealed that the M282Q mutation is clearly present in the large majority of the G1 plasmid library (data not shown). In all, it appears that puromycin selection was successful in not only selecting for functionally active variants, but was also likely effective for selecting hyperactive variants.

Referring to FIG. 6A) Several hyperactive PB mutations were identified via quantification of EGFP positive cells by flow cytometry, which is indicative of genomic transposition of the BII-sEGFP polyA-trap transposon. The M185L, A187G, and M226F mutations (boxed in red) appear significantly more active than wildtype PBo. Referring to FIG. 6B, the six most highly enriched mutations for each library after puromycin selection, among 77 and 24 sequenced clones, respectively, is depicted. The same three known hyperactive mutations (boxed in red) are also enriched in the puro-selected library. The F200W substitution was strongly suggested by phylogenetic alignment of 20 PB transposases (boxed in black). While the sampling size was small, restriction digest diagnosis of M282Q abundance (asterisk) in the plasmid library confirmed clear enrichment of M282Q.

TABLE 2

PiggyBac Transposase Mutations

| PiggyBac Mutation | Nucleic Acid SEQ ID NO: | Protein SEQ ID NO: |
|---|---|---|
| S3N | 93 | 94 |
| I30V | 95 | 96 |
| A46S | 3 | 4 |
| A46T | 5 | 6 |
| I82W | 97 | 98 |
| S103P | 99 | 100 |
| R119P | 7 | 8 |
| C125A | 9 | 10 |
| C125L | 11 | 12 |
| G165S | 101 | 102 |
| Y177K | 13 | 14 |

TABLE 2-continued

PiggyBac Transposase Mutations

| PiggyBac Mutation | Nucleic Acid SEQ ID NO: | Protein SEQ ID NO: |
|---|---|---|
| Y177H | 15 | 16 |
| F180L | 17 | 18 |
| F180I | 19 | 20 |
| F180V | 21 | 22 |
| M185L | 23 | 24 |
| A187G | 25 | 26 |
| F200W | 27 | 28 |
| V207P | 29 | 30 |
| V209F | 31 | 32 |
| M226F | 33 | 34 |
| L235R | 35 | 36 |
| V240K | 37 | 38 |
| F241L | 39 | 40 |
| P243K | 41 | 42 |
| N258S | 103 | 104 |
| M282Q | 43 | 44 |
| L296W | 45 | 46 |
| L296Y | 47 | 48 |
| L296F | 49 | 50 |
| M298L | 51 | 52 |
| M298A | 53 | 54 |
| M298V | 55 | 56 |
| P311I | 57 | 58 |
| P311V | 59 | 60 |
| R315K | 61 | 62 |
| T319G | 63 | 64 |
| Y327R | 65 | 66 |
| Y328V | 67 | 68 |
| C340G | 69 | 70 |
| C340L | 71 | 72 |
| D421H | 73 | 74 |
| V436I | 75 | 76 |
| M456Y | 77 | 78 |
| L470F | 79 | 80 |
| S486K | 81 | 82 |
| M503L | 83 | 84 |
| M503I | 85 | 86 |
| V552K | 87 | 88 |
| A570T | 89 | 90 |
| Q591P | 105 | 106 |
| Q591R | 107 | 108 |

Various modifications of the invention, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety.

SEQUENCE LISTING (108 sequences)

SEQ ID NO: 1 - DNA, 1782 bp, Trichoplusia ni
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 2 - protein, 594 aa, Trichoplusia ni
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 3 - DNA, 1782 bp, Artificial Sequence
  A46S PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaatccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 4 - protein, 594 aa, Artificial Sequence
  A46S PiggyBac
MGSSLDDEHILSALLQSDDELVGEDSDSEISDHVSEDDVQSDTEESFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 5 - DNA, 1782 bp, Artificial Sequence
  A46T PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaaaccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 6 - protein, 594 aa, Artificial Sequence
  A46T PiggyBac
MGSSLDDEHILSALLQSDDELVGEDSDSEISDHVSEDDVQSDTEETFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 7 - DNA, 1782 bp, Artificial Sequence
  R119P PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagcccggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 8 - protein, 594 aa, Artificial Sequence
  R119P PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQPGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 9 - DNA, 1782 bp, Artificial Sequence
  C125A PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatggccagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 10 - protein, 594 aa, Artificial Sequence
  C125A PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMARNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 11 - DNA, 1782 bp, Artificial Sequence
  C125L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgctgagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 12 - protein, 594 aa, Artificial Sequence
  C125L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMLRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 13 - DNA, 1782 bp, Artificial Sequence
  Y177K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatcaaggccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 14 - protein, 594 aa, Artificial Sequence
  Y177K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIKAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 15 - DNA, 1782 bp, Artificial Sequence
  Y177H PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatccacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 16 - protein, 594 aa, Artificial Sequence
  Y177H PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIHAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 17 - DNA, 1782 bp, Artificial Sequence
  F180L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcctgggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 18 - protein, 594 aa, Artificial Sequence
  F180L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFLGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 19 - DNA, 1782 bp, Artificial Sequence
  F180I PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcatcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 20 - protein, 594 aa, Artificial Sequence
  F180I PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFIGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 21 - DNA, 1782 bp, Artificial Sequence
  F180V PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcgtgggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 22 - protein, 594 aa, Artificial Sequence
  F180V PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFVGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 23 - DNA, 1782 bp, Artificial Sequence
  M185L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgctgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 24 - protein, 594 aa, Artificial Sequence
  M185L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVLTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 25 - DNA, 1782 bp, Artificial Sequence
  A187G PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccggcgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 26 - protein, 594 aa, Artificial Sequence
  A187G PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTGVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 27 - DNA, 1782 bp, Artificial Sequence
  F200W PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgtgggacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 28 - protein, 594 aa, Artificial Sequence
  F200W PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLWDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 29 - DNA, 1782 bp, Artificial Sequence
  V207P PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatgccctacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 30 - protein, 594 aa, Artificial Sequence
  V207P PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMPYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 31 - DNA, 1782 bp, Artificial Sequence
  V209F PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacttctccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 32 - protein, 594 aa, Artificial Sequence
  V209F PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYFSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 33 - DNA, 1782 bp, Artificial Sequence
  M226F PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagattcgacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 34 - protein, 594 aa, Artificial Sequence
  M226F PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRFDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 35 - DNA, 1782 bp, Artificial Sequence
  L235R PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccagacgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 36 - protein, 594 aa, Artificial Sequence
  L235R PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTRRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 37 - DNA, 1782 bp, Artificial Sequence
  V240K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacaagttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 38 - protein, 594 aa, Artificial Sequence
  V240K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDKFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 39 - DNA, 1782 bp, Artificial Sequence
  F241L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgctgacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 40 - protein, 594 aa, Artificial Sequence
  F241L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVLTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 41 - DNA, 1782 bp, Artificial Sequence
  P243K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcaccaaggtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 42 - protein, 594 aa, Artificial Sequence
  P243K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTKVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 43 - DNA, 1782 bp, Artificial Sequence
  M282Q PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagacagtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 44 - protein, 594 aa, Artificial Sequence
  M282Q PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRQYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 45 - DNA, 1782 bp, Artificial Sequence
  L296W PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatctggatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 46 - protein, 594 aa, Artificial Sequence
  L296W PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKIWMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 47 - DNA, 1782 bp, Artificial Sequence
  L296Y PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatctacatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 48 - protein, 594 aa, Artificial Sequence
  L296Y PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKIYMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 49 - DNA, 1782 bp, Artificial Sequence
  L296F PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcttcatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 50 - protein, 594 aa, Artificial Sequence
  L296F PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKIFMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 51 - DNA, 1782 bp, Artificial Sequence
  M298L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgctgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 52 - protein, 594 aa, Artificial Sequence
  M298L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMLCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 53 - DNA, 1782 bp, Artificial Sequence
  M298A PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatggcctgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 54 - protein, 594 aa, Artificial Sequence
  M298A PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMACDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 55 - DNA, 1782 bp, Artificial Sequence
  M298V PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatggtgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 56 - protein, 594 aa, Artificial Sequence
  M298V PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMVCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 57 - DNA, 1782 bp, Artificial Sequence
  P311I PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgatctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 58 - protein, 594 aa, Artificial Sequence
  P311I PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMIYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 59 - DNA, 1782 bp, Artificial Sequence
  P311V PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatggtgtacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 60 - protein, 594 aa, Artificial Sequence
  P311V PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMVYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 61 - DNA, 1782 bp, Artificial Sequence
  R315K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcaagggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 62 - protein, 594 aa, Artificial Sequence
  R315K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGKGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 63 - DNA, 1782 bp, Artificial Sequence
  T319G PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagggcaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 64 - protein, 594 aa, Artificial Sequence
  T319G PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQGNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 65 - DNA, 1782 bp, Artificial Sequence
  Y327R PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagagatacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 66 - protein, 594 aa, Artificial Sequence
  Y327R PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGERYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 67 - DNA, 1782 bp, Artificial Sequence
  Y328V PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtacgtggtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 68 - protein, 594 aa, Artificial Sequence
  Y328V PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYVVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 69 - DNA, 1782 bp, Artificial Sequence
  C340G PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagcggcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 70 - protein, 594 aa, Artificial Sequence
  C340G PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSGRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 71 - DNA, 1782 bp, Artificial Sequence
  C340L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagcctgaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 72 - protein, 594 aa, Artificial Sequence
  C340L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSLRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 73 - DNA, 1782 bp, Artificial Sequence
  D421H PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgccatgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 74 - protein, 594 aa, Artificial Sequence
  D421H PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCHEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 75 - DNA, 1782 bp, Artificial Sequence
  V436I PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatgatcatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 76 - protein, 594 aa, Artificial Sequence; identical to SEQ ID NO: 2
  V436I PiggyBac

SEQ ID NO: 77 - DNA, 1782 bp, Artificial Sequence
  M456Y PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgtacacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 78 - protein, 594 aa, Artificial Sequence
  M456Y PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVYTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 79 - DNA, 1782 bp, Artificial Sequence
  L470F PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgttctacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 80 - protein, 594 aa, Artificial Sequence
  L470F PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALFYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 81 - DNA, 1782 bp, Artificial Sequence
  S486K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacaagcacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 82 - protein, 594 aa, Artificial Sequence
  S486K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYKHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 83 - DNA, 1782 bp, Artificial Sequence
  M503L PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcctgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 84 - protein, 594 aa, Artificial Sequence
  M503L PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFLRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 85 - DNA, 1782 bp, Artificial Sequence
  M503I PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatccggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 86 - protein, 594 aa, Artificial Sequence
  M503I PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFIRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 87 - DNA, 1782 bp, Artificial Sequence
  V552K PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccaagatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 88 - protein, 594 aa, Artificial Sequence
  V552K PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPKMKKRTYCTYCPSKIRRKANASCKKCKKVICREHNIDMCQSCF

SEQ ID NO: 89 - DNA, 1782 bp, Artificial Sequence
  A570T PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaagaccaacgccagctgcaagaaatgcaaaaaagtgatctgccgggagcacaacatcgacatgtgccagagctgtttc

SEQ ID NO: 90 - protein, 594 aa, Artificial Sequence
  A570T PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKTNASCKKCKKVICREHNIDMCQSCF

SEQ ID NO: 91 - DNA, 35 bp, Artificial Sequence
  PiggyBac 5' inverted repeat
ccctagaaagatagtctgcgtaaaattgacgcatg

SEQ ID NO: 92 - DNA, 63 bp, Artificial Sequence
  PiggyBac 3' inverted repeat
ccctagaaagataatcatattgtgacgtacgttaaagataatcatgcgtaaaattgacgcatg

SEQ ID NO: 93 - DNA, 1782 bp, Artificial Sequence
  S3N PiggyBac
atgggcaacagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 94 - protein, 594 aa, Artificial Sequence
  S3N PiggyBac
MGNSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 95 - DNA, 1782 bp, Artificial Sequence
  I30V PiggyBac
atgggctctagcctggacgacgagcacatcctgagcgccctgctgcagagcgacgacgaactggtgggcgaggacagcgacagcgaggtgagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 96 - protein, 594 aa, Artificial Sequence
  I30V PiggyBac
MGSSLDDEHILSALLQSDDELVGEDSDSEVSDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 97 - DNA, 1782 bp, Artificial Sequence
  I82W PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagatggctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 98 - protein, 594 aa, Artificial Sequence
  I82W PiggyBac
MGSSLDDEHILSALLQSDDELVGEDSDSEISDHVSEDDVQSDTEEAFIDEVHEVQPTSSGSEILDEQNVIEQPGSSLASNRWLTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 99 - DNA, 1782 bp, Artificial Sequence
  S103P PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagcctaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 100 - protein, 594 aa, Artificial Sequence
  S103P PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKPTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 101 - DNA, 1782 bp, Artificial Sequence
  G165S PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccagcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 102 - protein, 594 aa, Artificial Sequence
  G165S PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTSATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 103 - DNA, 1782 bp, Artificial Sequence
  N258S PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagagctacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttc

SEQ ID NO: 104 - protein, 594 aa, Artificial Sequence
  N258S PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQSYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 105 - DNA, 1782 bp, Artificial Sequence
  Q591P PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccccagctgtttc

SEQ ID NO: 106 - protein, 594 aa, Artificial Sequence
  Q591P PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCPSCF

SEQ ID NO: 107 - DNA, 1782 bp, Artificial Sequence
  Q591R PiggyBac
atgggctctagcctggacgacgagcacatcctgagcgccctgctgcagagcgacgacgaactggtgggcgaggacagcgacagcgagatcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccggcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagaatgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacctgcgacaactggttcaccagcatccccctggccaagaacctgctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctgctgtccagctgcgacgaggacgccagcatcaacgagagcaccggcaagccccagatggtgatgtactacaaccagaccaagggcggcgtggacaccctggaccagatgtgcagcgtgatgacctgcagcagaaagaccaacagatggcccatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctgcgggacaacatcagcaacatcctgcccaacgaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccggagctgtttc

SEQ ID NO: 108 - protein, 594 aa, Artificial Sequence
  Q591R PiggyBac
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGYKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCRSCF

What is claimed is:

1. An isolated nucleic acid encoding a protein comprising at least 90% sequence identity to SEQ ID NO:2, and comprising at least one of the following amino acid substitutions in SEQ ID NO:2: a serine for the alanine at position 46; a threonine for the alanine at position 46; a proline for the arginine at position 119; an alanine for the cysteine at position 125; a leucine for the cysteine at position 125; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570.

2. The nucleic acid according to claim 1 wherein the nucleic acid comprises SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, or SEQ ID NO:89.

3. The nucleic acid according to claim 1 wherein the nucleic acid comprises SEQ ID NO:23, SEQ ID NO:25, SEQ ID NO:27, SEQ ID NO:29, SEQ ID NO:33, SEQ ID NO:37, SEQ ID NO:39, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:61, SEQ ID NO:75, SEQ ID NO:77, SEQ ID NO:81, SEQ ID NO:83, or SEQ ID NO:85.

4. The isolated nucleic acid of claim 1, wherein the nucleic acid encoding a protein comprises at least 95% sequence identity to SEQ ID NO:2.

5. The isolated nucleic acid of claim 1, wherein the nucleic acid encoding a protein comprises at least 99% sequence identity to SEQ ID NO:2.

6. The isolated nucleic acid of claim 1, wherein the nucleic acid encoding a protein comprises at least 90% sequence identity to SEQ ID NO:2, and at least one amino acid substitution selected from: a proline for the arginine at position 119; a serine for a glycine at position 165; a leucine for the methionine at position 185; a glycine for the alanine at position 187; a tryptophan for the phenylalanine at position 200; a phenylalanine for the methionine at position 226; a lysine for the valine at position 240; a serine for an asparagine at position 258; a glutamine for the methionine at position 282; an isoleucine for the valine at position 436; a phenylalanine for the leucine at position 470; a leucine for the methionine at position 503; an isoleucine for the methionine at position 503; and a proline for a glutamine at position 591.

7. The isolated nucleic acid of claim 1, wherein the nucleic acid encoding a protein comprises at least 90% sequence identity to SEQ ID NO:2, and at least one amino acid substitution, wherein the substitution is a proline for the arginine at position 119.

8. A vector comprising a nucleic acid encoding a protein comprising at least 90% sequence identity to SEQ ID NO:2, and comprising at least one of the following amino acid substitutions in SEQ ID NO:2: a serine for the alanine at position 46; a threonine for the alanine at position 46; a proline for the arginine at position 119; an alanine for the cysteine at position 125; a leucine for the cysteine at position 125; a lysine for the tyrosine at position 177; a histidine for the tyrosine at position 177; a leucine for the phenylalanine at position 180; an isoleucine for the phenylalanine at position 180; a valine for the phenylalanine at position 180; a leucine for the methionine at position 185; a glycine for the alanine at position 187; a tryptophan for the phenylalanine at position 200; a proline for the valine at position 207; a phenylalanine for the valine at position 209; a phenylalanine for the methionine at position 226; an arginine for the leucine at position 235; a lysine for the valine at position 240; a leucine for the phenylalanine at position 241; a lysine for the proline at position 243; a glutamine for the methionine at position 282; a tryptophan for the leucine at position 296; a tyrosine for the leucine at position 296; a phenylalanine for the leucine at position 296; a leucine for the methionine at position 298; an alanine for the methionine at position 298; a valine for the methionine at position 298; an isoleucine for the proline at position 311; a valine for the proline at position 311; a lysine for the arginine at position 315; a glycine for the threonine at position 319; an arginine for the tyrosine at position 327; a valine for the tyrosine at position 328; a glycine for the cysteine at position 340; a leucine for the cysteine at position 340; a histidine for the aspartic acid at position 421; an isoleucine for the valine at position 436; a tyrosine for the methionine at position 456; a phenylalanine for the leucine at position 470; a lysine for the serine at position 486; a leucine for the methionine at position 503; an isoleucine for the methionine at position 503; a lysine for the valine at position 552; a threonine for the alanine at position 570; wherein the vector comprises at least one regulatory element operatively linked to the nucleic acid sequence encoding the protein.

9. The vector according to claim 8 which is a plasmid or retrovirus.

10. The retrovirus according to claim 9 wherein the retrovirus comprises long terminal repeats, a psi packaging signal, a cloning site, and a sequence encoding a selectable marker.

11. An isolated cell comprising the nucleic acid according to claim 1 and at least one regulatory element operatively linked to the nucleic acid.

12. An isolated cell comprising the vector according to claim 9.

13. A kit comprising:
a vector according to claim 8; and
a transposon comprising an insertion site for an exogenous nucleic acid, wherein the insertion site is flanked by a first inverted repeat sequence comprising a sequence at least about 90% sequence identity to SEQ ID NO:91 and/or a second inverted repeat sequence comprising a sequence at least about 90% sequence identity to SEQ ID NO:92.

* * * * *

UNITED STATES PATENT AND TRADEMARK OFFICE
CERTIFICATE OF CORRECTION

| | | |
|---|---|---|
| PATENT NO. | : 8,399,643 B2 | Page 1 of 1 |
| APPLICATION NO. | : 12/712504 | |
| DATED | : March 19, 2013 | |
| INVENTOR(S) | : Eric Ostertag et al. | |

It is certified that error appears in the above-identified patent and that said Letters Patent is hereby corrected as shown below:

In The Claims

Column 33, line 52, claim 4, that portion of the claim reading "95%" should read --90%--.

Signed and Sealed this
Ninth Day of December, 2014

Michelle K. Lee
*Deputy Director of the United States Patent and Trademark Office*